United States Patent 7,411,051 (ANTIBODIES TO HDPPA04 POLYPEPTIDE) - sequence listing, part 3

SEQ ID NO: 3195 - DNA, 1947 bp, Homo sapiens
gttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattycaccagargctgaagagctgtcatttgaagtgtcttattcagaaatggttacggaggctctaaaaagaaataaacttaagaaatcagagattaagaaagaagactatgttttaactaaatttaatgktcagaaaaccagatttggcttaacttgaagcaggagatctgkctgctgaagacatgaagaaaatccgscatctctctytgawtgaattgactgccttttttgawgcctttgggaattcrrctgaaaaggaaccaaaacagagaaagtaaaaggacsagacaatgggatttttggagttccacttacagtcctcctggacggtgaccgaaagaaagaccctggagtgaaagttccccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcraagtacagtttcaagccttacacmtcrkgstcatggcgctgcctggatgccaacagagatgcagctcaggccctcatgacattcttcaataaagtgattgccaatgaatcaaaaaaccgaatgagtctgtggaacatttctacagtgatggcaccgaaccttttsttcagtagaagcaaacactctgattatgaagaattactgttagcaaacaytgcggcccacatcatccgcctaatgcttaagtaccagaagattttgtggaaggttccgtcttttwttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagtcatggttcatcagaatgtattaagattcagaaccaaaggttatatgaaattggaggaaatataggagagcattgcttggatccagatgcttatatattggatgtatatcgtataaatcctcaagcagaatgggtgattaaaccccaaccaagttcttaaaatatcctcgagagagctgctatcatgtattatatgccaaaaagatcctacattttggtagggaaaaamaacactgtgtctgac

SEQ ID NO: 3196 - DNA, 792 bp, Homo sapiens
  misc_feature (759)..(760): n equals a,t,g, or c
  misc_feature (774)..(774): n equals a,t,g, or c
  misc_feature (779)..(779): n equals a,t,g, or c
actttccagctaaaaaccaacaagtgtctgaggacacagtttaaactccaagatgatagggtcctccctcacctgggctcccacctaccctcatgacctccttttgtgaaatgctgaagggctctgcagctggttgtctggtactgctggcctttgctttctatttagcatgttccttctcccacaaaacaaaatcacattctcactatgccctgttcattcttcaggactatcttctgggaaacttttactacatacccctctccccctaatctgagtgtctgctttgctcaggtagcatgtgttcactggataaatccttgattcctggcactgaggcagggtttctgttcccaggaagcagaggcatactattctgtgaaggattgactgagtttctcctaataccaagcagtatctgagggaacagatgtctagcttaaaatcctccctagcacttgtcatagcagtgctacgtattgcctgtgaaggaagtttaataactgctgaaaggttcgattagctttatttcatcaggatttgtttgactttacaaattgatttgggttattycaacttttaggtctagtcttaagtataactggtacatattccttcaagcagccattacacctctcataaatttattatacacctgcatttttataactattatgctttttaattgttggccaccatttttagtgcttctgaattgttatggttctcaagcagcagttgtcaccttggttttgaatnnatgctgtgacggangcttncaggggaattccc

SEQ ID NO: 3197 - DNA, 765 bp, Homo sapiens
  misc_feature (671)..(671): n equals a,t,g, or c
  misc_feature (680)..(680): n equals a,t,g, or c
  misc_feature (683)..(683): n equals a,t,g, or c
  misc_feature (699)..(699): n equals a,t,g, or c
  misc_feature (740)..(740): n equals a,t,g, or c
  misc_feature (765)..(765): n equals a,t,g, or c
gtttttttttttttttttttttagaaatactagaatttcttcctttctccatgtttacctgacatataatattcttcagaaaatggagcacattagcgtttataattccatactccagtgtttctggcataatttccatagcttccttcatgtcggtagcttcagagattgcctctttggtatttctgaggaaaaacaccacgttttggtccaggaactcctcgggaagaggggtacagagcatgtggagatgcatcttttccatgatgtgcttcgcagttcttttggaagggagtttttctgaaatctctttgtccatttcttcatcctctctgtttagaggttggcctagagattcggttctcagtgacacacgcttagctcgcactttatccacggactccactttttgagaataagtctcttcttcctcttctccctcttcagacaggacaggtatctcatcaatctccacctccacctcctccggcaccatagtgcggtagatgaagagcgccgagggcccctcctcctcgctcgcctggttgaggaagtgcaagatgaggtcctcgccctggccgtcgtcgcggttgagcaggtcctcgaaaagctgggggtcggtgatgccgaaagccgcatacacgcgcggcacgaaggggggggcccggtanccaattcgnccnataagtgagtcgtatnacaaattcactgggccgtcgtttacaacgtcgtgactgggnaaaacctggcggttaacccaaactn

SEQ ID NO: 3198 - DNA, 1042 bp, Homo sapiens
  misc_feature (322)..(322): n equals a,t,g, or c
ggcacgagctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccanaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctgggaacttgtgggcagcctgcgtactccagtcctgctaacccctagcttttaatataaagtgtttgtctgaatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3199 - DNA, 1508 bp, Homo sapiens
  misc_feature (1469)..(1469): n equals a,t,g, or c
  misc_feature (1481)..(1481): n equals a,t,g, or c
gcawcttagatccggccccggtccccgtccccttccctcccccctgccctaagccacctccacctctgtcctggccgcctcagggcgccctgaaaggaccaggacatgcggctgcgcttttggctcctcatttggctcctgctgggatttatcagccatcagcccacccctgtyatcaatagtctggctgtctatcgtcatcgtgagactgactttggtgtaggagttcgagaccaccctggscaacatggcaaaaccccatctycacaaaaattggataatttgataattatcattattgggtttctgagacgttacacatttamcattctcttctgcacaagttrcctttgtgtgtctttcctgaagactatcttctggtctcgaaatggacatgatggatccayggatgtacagcagagagcctggaggtccaaccgcagtagacagaaagggctgaggtccatttktatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcataacaaaatcaatggaaagaggaagaccgccagaaaacagaaaatgtttcaacgtgcgcaagagttgcggcggcgggcagaggactaccacaaatgcaaagtaaggagcttcctccccgcagttgcaggatagttcagtgctgatgcagatgatgccacggctcttagactctctcaacattcaatttctcatgtgttggctttttcagatccccccttctgcaagaaagcctctttgcaactgggtcagaatggcggcagyggagcatgcgtcattcttcaggattgccctrctggccctacctcacagctgaaactttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtgtctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgakaacacgccattgcacttragtgcaatangaataaatccgnggcccgaaaaaagaaaaaaatctaaac

SEQ ID NO: 3200 - DNA, 1060 bp, Homo sapiens
ggcacgaggtcacgtgggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaagcttgcactttccagtgacaagattgctgcattacgaatgccacttttaagcctgcatctagatgtaaaagaaaatggtgaagtaaaaccttattctattgaaatgagtagagaggagctgcagaatctaatacagtccttggaagcagcgaataaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataaagataaaaatttatcaacattccttaacaggaaattacatggttgagaggaaatgcataaaatgaaagatgaaaaatctatagtagcagtttatattttcatgattgttttgcctcatttattaaatatttgagaaatctttggagatacatagttttattgaaagctaaaaataggttctaaagtaatgtaaaaatataaagcacaaatatacttgaatattgcttaaagaattgtgtgaatagcaacatatattatggatatatactttgtgatatttttaaaaaa

SEQ ID NO: 3201 - DNA, 1249 bp, Homo sapiens
ggcacgaggcagtgcacacccccatggcccgggctttggtccagctctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggtctgcaaaccactcagaatggccgattctatgccatctctgcacgcttcaaaccgttcagcaataaagggaaaactctggttattcagtacacagtaaaacatgagcagaagatggactgtggagggggctacattaaggtctttcctgcagacattgaccagaagaacctgaatggaaaatcgcaatactatattatgtttggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaatcgaaggattgggaacagactaaagacaacaaagcccaggactgggagaagcattttctggacgccagcaccagcaagcagagcgactggaacggtgacctggatggggactggccagcgccgatgctccagaagcccccgtaccaggatggcctgaaaccagaaggtattcataaagacgtctggctccaccgtaagatgaagaataccgactatttgacgcagtatgacctctcagaatttgagaacattggtgccattggcctggagctttggcaggtgagatctggaaccatttttgataactttctgatcacagatgatgaagagtatgcagataattttggcaaggccacctggggcgaaaccaagggtccagaaagggagatggatgccatacaggccaaggaggaaatgaagaaggcccgcgaggaagaggaggaagagctgctgtcgggaaaaattaacaggcacgaacattacttcaatcaatttcacagaaggaatgaactttagtgatccccattggatataaggatgactggtaaaatctcattgctactttaaaaaaaaaaaaaaaaaaaaaa

SEQ ID NO: 3202 - DNA, 2412 bp, Homo sapiens
ggcacgagcttaatctcgctgcgtgctgatctctggcctttccctttagtctgtccgagtctccccttttgggacatcattcttcttctgatgctgccaggagacgctctgtctcttccttcccagtcccccaggacaatgtggatgctcatcctggttctggtaaagaagtgagggtaccagctactgccttgtgtgtcttcgatgcacatgatggggaagtcaacgctgtgcagttcagtccaggttcccggttactggccactggaggcatggaccgcaggtttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaaaaaaaaaaaaaaaaaaaaaa

SEQ ID NO: 3203 - DNA, 866 bp, Homo sapiens
  misc_feature (833)..(833): n equals a,t,g, or c
gaatacgccagctctaatacgactcactatagggaaagctggtacgcctgcaggtaccggtccggaattcccgggctcttgatctttcctggtcctggtacggggatgacctctcttttagaggggcgaatggttctctgtgtctcctgcctcctccttcccctgctgttgttgctgaaacactttaatgggttgatgacaccatatttagctcataatgtatattgtcctatagaatatatttcttttttcccatttcatgaaaaaaatatagaatatatttctatttggttcatctttgacagttttaagtttatctattcgaggcttttgtgtatttcccaaatttatgtgctttatagagcatatactttgccccattagatgcagtggtattgcaatagttatcctcagggaggtaggctgtgtgtgtgtgtgggtgtgagtgtatgtatttgtataaaagaaaatccaatattacatgcatttggccgggcacggtggctcacatttgtaatctcagtgctttgggaggctgaggtggacaggtcatttgaggtcaggagttcgagaccagcctggccaacatggtgaaactctgtctctactaaaaattaaaaaattagccaggcgtggtggtgtacatctgtaatcccagctacctgggaggctgaggcaggagaatctcttgaacctgggaggtggaagctgcagtgagccaagattgcaccactgcactccaggctgggggacagagcaagactccggtctcttcaaaaaaaaaaaaaaaaaaaaaaaaaaaaaaaaaagggcggccgctctagaggatccangcttacgtacgcgtgcatgcgacgtcatactct

SEQ ID NO: 3204 - DNA, 1210 bp, Homo sapiens
aaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtgtcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagtgccgggctgccttgaacagttgcacaggttgttcaccatccaaggattcgtggcccaggggccaggtggaggctgacacccaacttgtgctccgcttgccaaaatgcgtgtcctgtctcgaggctgagtcagcccagaggggagctgccttttactgattcttcccagggttggcaccggccccaggagtgtagactggtgtgaagcatctgtcgtacgcgatcattcacctgctggctcattggttttcaagctgttttcagccatgctgacaggctcttaggaaggctggtaataaatcccgcagataaaaaaaaaaaaaaaaaaaaaaaaaaaaaaaaaaaaaaaaaaaaaaaaaaaaaaaaaaaaaa

SEQ ID NO: 3205 - DNA, 1928 bp, Homo sapiens
  misc_feature (695)..(695): n equals a,t,g, or c
gctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccamcctgcaggagcagctaaagaaaaataaaggtttccggaagtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacgtaggttcttgctcctcggcaacgcaggctggaggcttcctctcctgtattcctttctgattctgacctccaacaatgtctggtatgaccctatcttccactgacatgtatacagtgtccctactgctctgccttttnttcaagaagtcagaccctgaccctggtcccttccagaataacctctttcacaaccatggcacccaaagtcaaagttgtatggggagtaaggtgggagatgttattccaggggctgcccgactgataagtgagactgcccagagagtccatactattggtcagaaacagaagaatgaccagcaccttcggcgtgtccaggctctgctcagtggacgccaggcaaaggggctgacctcagggcgctggytcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtggtgggttgctcagtctgtccttccctcgtgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccmctggatttgagtaaagttttttttcttttttttgggaaaaaaaaaaaaaaaaaaaaaaaaaaaaaaagggcggccgctctagaggatccaagcttacgtacgcgtgcatgcgacgtcatagctcttctatagtgtcacctaaatca

SEQ ID NO: 3206 - DNA, 2479 bp, Homo sapiens
  misc_feature (240)..(240): n equals a,t,g, or c
tttaaaacagagactgtccacttcaagcttcagatgagaattacagtcagattccagccctgctatttactagctacgtgaccttctgcagggcatgttaccgctctgggattgggtttcctcatgtggggctgtagaaggtgcactcaatttactagatagaggtcaaaggatgtacttcaacttctggctctgcactttgttgctgtgcgaccttggacatgctgcttggcctgtaancttccgtttctataaaatagggataacgcttccttccagggaggttttgaaagtgggatgagggatctaagatgcctaggacacatgagtgcttaagccatgttagtgtcttctcctttctcttcacctgtttctttctgggctgtttttgtttgtttgcttttactttataaaataagaacagtgaactacctattatgcagatctcctgcctttcatagtgctttataaactgtgaagcagaaagcagaatgtgtggttgtttgggcaccaggaggacaaaggtccccaggctttgaatttctctgacctctctaaattgtgtttgaattccagagaagagctctgtttttctaggtgagaattaggcaagcttttcctggagctcaccccagtcagcaccctgagggctgagggctgagggctgagggcttcccttccacaagacctccctgtctttgtgaggctcagcatcacaaagccacctggggagtcaagggtmrgtattgttcttcagagacacctggatgctggctcactccctgaggaggagggaaagctgctctggcctttgaaacattgtattgaaaactcacacacagaagccaaaamtgacaaggatgataagctgctaatatgctaataataataataatgagctatgcctgttcttcacatactgtgctctgagagaggttaaaatgcctttaggccagtactttgatttttttttttttttttgagatgaagtctcaaaaaagctccgtcgcccaggctggagtgcagtggcatgatttcggctcgctgcaacctccgcctcccgggttcaggcgattctcccacgtcagcctcccgagtggccgggactgcaggcacacgccaccatgcctggctaattttttgtatttttggtggagatggggtttcaccatgttggccaggctggtctccaactcctgacctcaggtgatgcacctgcctcggccttccaaagtgctgggattacaggcacaagccacagtgcccggctaggtagaagtttagaagagttcattaagactctgccactcggtggatttgtaacatgtattaaacattaaccctctctgggcctgagtttctctatcttaagatgaggaaaattggtgaaataatacctaacacacttcctagctctaactaactttgctaggccagatgcttacaaattgaaattctttgatgtcaaccctgtcttattccttggacaaaggggaagagaagaaaggtcttagtttttacaacgcaaccagcatgtatcaggcattatatgagggactttatgtacactaatgtatacactgatttctagcacagcattgctttgttaatttgmcaaatgatcttctaaargggtgggcacgtgtgccaagggtactwtcacaaggttctctaattttaatcttatcaaggaaacaagtawtcaaaagacagaaatgggaggcagaattagtacataattttaaatttgcattggtgtgatactatactagacactggaaataaggtaatcacagttaacctactaaacagatattttacttgatagcaatagagaatacataatatgtctaaatcaagtatcctgtataaatcacaggtgagctatttctcaacacattatttgtttccttccttctctacttaaaaaaattatacacataattcataaatcattctcattataaaagggtcaacaacatagagcaaagacttaggggtcattctctactcagccttcctttcagcccccagccccttacctcactctctcaccacccaatccccttaacagagaaccacaatgatgtatattccaagtcactttcaagttaaatttcattattggtatccttacattttcctttaagaaaaaagaaactctgggccgggtgcagtgctcacgcctgtgatcccaacactttgggaggccgaggaggctggatcacgaggtcaggagattgagaccatcctggccaacatggtgaagccccatctctactaaaaatacaaaaattagctgggcgtggtggtgcgcactgtagtcccagctactcgggaggctgacacaggagaattgcttgggcccgggaggcggaggttgcagtgagccgagatctcgacactgcactccatcctggcaacagagcgagctccgtctcaaaaaaaaaaaaaaaaaaaaaaactcgagcggcacgag

SEQ ID NO: 3207 - DNA, 838 bp, Homo sapiens
gaattcggcacgagccaaaacaaaagaaacctttggaggcatgtgtcagaacagagaaagtgtcctggttttgcttatagaatcaaatatgttctcattctacctactgttttcattctacatagtgttttccttctttatagttttacgtcctcttcctaggaatgagtctattaagaaaataggtgttatcttttagctttggcatttgactttcaggataatagagctatctgctactgacagaaaagctttgacaagtgtttaatactctgggattaccttcatcttacttttgcaatcattatgtgaacattgtcttccgtccacatctayaggctagtawgtaacaccgttgactaaatccaaactttaggctagggaaaaagggtatactttctgggtttcggttgtagattatgtttagatctaaycaaaacaggacagtggtccaaacagaaaattgctattttctgtatcttgtaaatctaggatttgagtttttaagatgaatttatggttccctttctgatatcatttctcatctgcagctcctaatgcctggtaccttgggtatggagtgaggagagacaatggacagttttatataagaaatggaagtaatgatactatctttcctggaatatttgcaggccccagaggagatgatgagcaaggactgttggcctgtattacacacaacagggttgtagttactatcccagcaaggaaagggtgtatctttcttctttcatgcaaattatctatgatgacctaacagtttgattatagtgagtggactaaccacaacaataaaaaaaaaaaaaaaaaactcgaa

SEQ ID NO: 3208 - DNA, 1495 bp, Homo sapiens
cggcacgaggctacttatattttatgaaggacattttttgttagatgatctcatcctctgtgttatttgttgattgggtttgttttttgcttgttggtttgtttgtttcttccatgtaaggaaaagtagtgtaagcagtaggaagaaaatgaggaagatgtattttgcatgttcttcctttcaatgttcttacacattgtattactgcattgtggtaatagcttctataaaatctgccatagctgggattatgcagctttgcaagaatctactagattttattctaactcatattagcttgtcctatcaacttctggaattatctaattattgcttttaaaagtttcctgcctttcaacgtttccctgctatgcaaaacctttcccagaccttggtttcttaaaagaaagatgttgctacagttcccaattctttcttattacaggctcaggtgtacaggttattctggcttaattttatctaatgaagcccattcctttttgtacatgaagatgtcacttaaacctatgtttacaaactaaagagactaatcactcaatatgaaaacatgaaaacatttttgcttaaaatattaagatggaaatagttaaatatggattattttgtccttttactttttaaaaaaagttacatattgtatgcactgtgctgatgcaagaattctacattttaatgaattataaaattattctgcatctcatcacgtcacagtatttctgctctatttattcatatacatagaaatatatatgggcttaatcatttaaaatttgttgcagcaagaactctcctacctgtaggcaatagattgctatgttttcaacaaattgtggcaaattctaaacagcaattcttttgtacgtaataggacatttcatactagaaaaataaagtaatgtttttgacattggatttggtgcagtttctaatgaagcaatggttggttggttaatatgtcttctgtagctgttagcattgccaaattaaaaagggtaaattttatggaaatcctgagaccaggaagatatcaatttcatgtgtacttaatggtataaagtgttttacagtttctatcaccatacaaatacataaagacattttatagttttatcaactatagagctttagtctttcaaaagtaatttttgaaaaacatacattcctggccaggtgtggtgggccacgcctgtaaccccagcactttgggaggccgagggaggggggatcacctgaggtcaggaatttgagaccaacctggccaacatggtgaaaccccatctctactaaaagtacaaaaattagccaggcatggtggcaggcacctgaaatcccagctactagggaggttgaggcaggagaatcacttgaacctgggaggtggaggttgcagtgagccgtgatcacgccattgcactccagcctgggggacaagagtgagacttcatctcaaaaaaaaaaaaaaaaaaaaaaaaaa

SEQ ID NO: 3209 - DNA, 608 bp, Homo sapiens
gaattcggcacgagcttcactccttgttccctctcctgcacacacacacacacacacacaccccaggagactctaccccaactcagccctaacccagccgaacaaccttcagtggctccccagtgcctgaagaatatgatccaaactttccctgcctacctctgtcttccccttttttacgtgctggacctggcccttgcttctgctcctgtactttctcattcagctctcctctgacatgttttcttccttccccacaaggccagcaaaaatatcacctcctccaggaagtcctccatgaccagtgagcwcaccaggaacttctgcttttgagcccccagaaagagccatgctgcagaagtctccccatgctgcttctaacccaaataaagtacaggagaggagttcaggaaaaagtctagagccaggcacagcagtacacgcctctactctcagctamtcgggaggctgaggtgggaggattgcttgaacccaggagtctgaggctgctatgcaytatgatcacacctgtgattagccactgtactccagcctgggcaacatagcaagaacctgtttcttaaaaaaaaaaaaaaaaaaaactacga

SEQ ID NO: 3210 - DNA, 1553 bp, Homo sapiens
ggcacgaggggatgcagcagagaggagcagctggaagccgtggctgcgctctcttccctctgctgggcgtcctgttcttccaggtgagtgctccggctggctacgctccacttccggccggggggttagggaagatggtcgcttttccggttccgggtaggggggtctccagaaagcccccgcatagctctgggaaggaaggagggagggagcgggacgttgggacgatgtcatcaccaccccgttgaggatagttggtattttgtcagtcctttcctgagccttgggagctttttcaccttgcgtgacctgtcattgtatttggtgatacatacttgatggaacacaaatagctctggctttgggggcacccggtgttattttgtggtgttattatcagtggttgaccgctgtcgtttgggcgctgtataccctgattagaaagaaaacagttctagcattcagtagtttgccccagtagttttgggaaacaaaatcatgacagttggtaattttattttttgtagtgattattgtagtctataaaatgaaatatttgctaatcacagaaaggatgtgatgtgattcgttatagaaaaacatatcgatgaaaaagtactgctttagcatttcataactttttttaatacaagaaagagcatataaattctgttaaaatttattaagtaatatcagaagtagggtattcacactgacattcacatcttaaaattaggtgagttttgctttcatataattttcagattgcataaatttcaatccagcctaattaccttcatctcaaggtacaattatttcctggattttgtgtatgtgtgtcttcctgggaaataaaatattagtatatctagtattagagtgaattgctaaatttataaaatttccttgagggtaatggggatttctgaaagagatatttaatattatataaatataaagactttaatataaagacttcagatgtcctaaatcttagcagttaaggctggaaagtttttaactgttgactaatattcatgttgccagcacacccccgatccctcccagctgcctgtgtcatcataagtctccagtttttaagctaaattactttgcagtatgatatttagctggcctactgtcactcctaataaacccagtcctctctctctctctttctcacacacacacacacacacacacacacacacacacacacacacacgagaaatattcaaatattgtcttattgagaaaaaaaatctggaaatggtgttttcttaaatctaatgtcatgttgctttgaagagcatctgtcaagtccagcagaccatataattcaatcaaacatttaaagttgattttacaatctctatgtacttgtggaatagattttttgccttttaaaaaataactggtggcagggtgtggtggttcttgcctgtaatcccagcactttgggagaccgaggcagctggatcacctgaggtcaggagttcgagaccaggctgaccaacatagtgaaactccgtctctactaaaaaaaaaaaaaa

SEQ ID NO: 3211 - DNA, 1939 bp, Homo sapiens
cctgttttccctctcccttctatgctgaatttcctgctatctaatagcctcctcttaaccatagtgtcaatagttttgcttttcctggttttagttacctgtggtacagtacaagaagatgagagagaaagagagagagaccattcatgtaacttttattatagtatattgtaactgttctattttttattattgtaatttcttactgttcctaatttataaattaaactttatcacaggtatgtatgtataggaagaaacatagtgtatatagggtttggcattataagtagtttcagacatccactgggggtcttggaatggatcccctgcggataaggggggactacagtctttttgaaaatcccttagcttgtattgccaacatgatatgtaaactaagaacagacttaccttgagagtagacctaagatattctactacaagttaagtgcatggtgggtgtgaatttctctctcctgcctctgaaccttttttttttcttttgagaagcaagtgcaggggagagggtacagtggcttactctaccctgttgtttgactatgtgttgacgtagtgttttccaagatattcttcatgtattcccagagttttgcagagcctaccaggaactactatgtaacacagtatgagaggcgaatcaggactttagggtaccttatcttacctcaggcagagcatttctgcattcatatgttttactaaaagttttgcaggtctggttttgtttgagcaaagagtttctttgcttaaaaaacaaaactttaaaactactatttagataattggacttgttggctgagttttggatatgtgatgttaattatacagttaaaccataagcactttaaggttttataaaaatatatttgccttaagccatttctaaaatatattttccaattgagggatttaaatgctttgatttgatcaattactttaaaatgatgctttaaaaacacattttagaacacagcaatccaaaatttagagcatcaattacacaagaagtaaaattgtacaaaattaagggcttatttacatctaagtaagtagtgtatgtaataaaatagcataataaaaaggctctgagtatattgatggaggcatatcatttggtccaacaatgagggaataggtctttttaaaaactaacaacttaatctttatcagaaattgcctgtttaaatgaaaggtaaataatttgaaaagaaaaatgtaataaataagagggtatgtttttgagaatataaaagtttaaatattaaagtgtttataaatattgctataaatgcatgtgtgatccagggctgagctcatctggaattgggaggtagaccaatttctctatatcccatgaatggcttgggcaactccttgaccattgggtatacagaatgttaattgatgttgtttgtgtgtctcttgtagttctcttgacctacaaagaatcaaggtgtagaagttatatatttgaagggctgggtttgtggaaaaatgatcagtgttttataaatctaggaattatgaatataatttagagaaaggcaaatttcagtacaataatgagaactgaccaaaaatggatttcaaatagaactgttctaaaaagggatttggggccgggtgcggtggctcatgcctgtaatctcagcactttgggaggctgaggtgggcagatcacctgaggatgggagttcaagatcagcgttaccaacatagagaaaccccgtctctgctaaatatgcaaagttagttcggcgtggcggctcatgcctgtaatcccagctactcgggagcctgaggcaggagaatcgcttgaaccagggaggtggaggttgcgtgagtcgagatcgtgccattgcactccagcctgggcaacaagagtgaaactctgtctcaaaaaaaaaaaaaaaaa

SEQ ID NO: 3212 - DNA, 1617 bp, Homo sapiens
ggcacgaggcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaaaaaaaaaaaaaaaa

SEQ ID NO: 3213 - DNA, 872 bp, Homo sapiens
gggctacttcaaagccctgggccttatttcttcaggtaaaaaaatataaagtcagatctcatcccggctggccatgctgttagaccctttcatccttctcttctgcctcttctcaacagctgcccagtcctgtttggaattcatatacatacagttctaatactgatgtatttaccctcataagccactcaacccagaatcttatttgaattataatccagaaacatcaggtgacgtgtgagactactgtatgagaaagagacagtttaagggtcagtccaatggaaaaaagagttctcagagctttctttagcttattctcatcaaagagctttctctgcagaaggaacctactggttcctcctttccagtcctagaaatcctgacctagagtggcttaatcctgctagcacctctctctcgcactctggtgccaaatgactccaggaactgggccatgatgtggtgggaatgaccttaccctgagcatgtcactcatgcattgaacaacagctaagagcagagcttagagcttagagctgggccctgtaaggtgagaggaatcacatcctgcagaagtctgtcctgagaagcaggtactcctgtcacagcagagacacagtggatacctgagtaacaataatacaagacaggacgtgggmacagcaaaagatttgggtgtcagaagargccgagaacacttycaggcaggaacattcararttgttcttggaggaartaggcmcsaaggctgggcaggatttcmcggggcagagatggagcaagcaattgaaatgaaagccatggcatgggaaaaggagcactggccacagggagtgcaacgttgtgatgcaaggccactgtggagccat

SEQ ID NO: 3214 - DNA, 3684 bp, Homo sapiens
  misc_feature (79)..(79): n equals a,t,g, or c
  misc_feature (2297)..(2297): n equals a,t,g, or c
  misc_feature (3679)..(3679): n equals a,t,g, or c
ggcagagggggcatgagcaggaggaggattaccgctacgaggtgctcacggccgagcagattctacaacacatggtggnaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgcccyttctggtgttggtatgtctgttgccggccatgggctncaygccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaaaaaattcgggggggggcccggtncccat

SEQ ID NO: 3215 - DNA, 1244 bp, Homo sapiens
ggcacgagattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaaaaa

SEQ ID NO: 3216 - DNA, 1794 bp, Homo sapiens
  misc_feature (457)..(457): n equals a,t,g, or c
gaagcatttagtaggattttaaagaaacttgagaactgttacataaggtgatgaattgggcatagcatgtaaaattatatttaagcaaggaaatgatctctggtgttttaatattcaacttgattgcttcctcttgggttctgtgtttcccactgtgtgacctgagctgtcagaaaaccttaagaattttctttgcatcatttttccatgcagtttgtgtacatgtctcatgtacctcgtggcagccactggttttgttcatcaaatggtgggttgtgggatgctctcctgcagtctccctctaattaaagaggttaaattgccgtttgctcagcctttagttcctttccacagcttcctaggctcttaaaaattagcactatattcctttcagattaaaaaaaaaacaaaaacaaaaacctgtttgctgtctttactgctgtggtcttgtctagangcaaatctgaacaaactgattgaaaggggtgtttggtggctggtgttctctttgactaaagaggcttacatgtactgtggtacagtctgcttacttaaaaggtgaggcttgaattaaaatmcagccagatakaagccagactctaatcaaatgaggtgattagatcaatgaatgaagagaggagaggagtcaggtgttgcctttccctggctgttgaatagctgatgttccagattgccctacagtgttgtgttagggcatccaggagggatmcttttcaggcttaggtacacctcagtctttaaaatgaggaattakgacacattcatgtgtgtgtccctaatctgctcctgagaagagaagtgcaatcagggtcttattttgtgaccactgacttgcacactgagacaaaagggccatctgcaagctgaaaatagtggattccttaaaataaaacactattcacatttgatggtgtggtagttttrakaaaatgttcaagtgtcaagttcattttcatttataatctgagacagttttataagtcacctccctgggggtaaaaatgcatgttctgtcctcatagtgagacacatcttctgcttagagtctagaaagctctaagaaagatttatgccatctgtgcagctggcatttttatagtaaaattttttttactttgctccaagtttaagttatctcatgacaaactttcttgaaagaggcattcactattattataggaagtatactyctttattgaaaaggagataatgtatcaggtaacttattaaagtattttctcaaagtttagtatctttaggaatacagtgcctcaatacaatataaaatattttgtaaataatagaatgaattcattttagaatttaaatgatgctaataaaatagaccattattctaaaagtttaactaatttagaatcaaccctggttgaaaataagccttaagctgtttttttggaagactttaaatcctttatggctaagagatgacagacagggccgagtgcggtkgctcatgcctgtaatcccagcactttgggaggccgaggcgggcggatcacgaggtcaggaaatcaagaccatcctggctaacacggtgaaaccctgtctctactaaaaaatacaaaaaaaattagccgggcgtggtggcgggcgcctgtagtcccagctactcaggaggctgaagcaggagcatggtgtgaacccaggaggcagagcttgcagtgagctgagatcacaccactgcactccagcctgggcaacagagcgagagagtgagactctgtctcaaaaaaaaaaaaaaaaaaaactcga

SEQ ID NO: 3217 - DNA, 884 bp, Homo sapiens
ggcacgagcagaatcagggcactgagctctactgtaagtgtgtatttaatctccatttttaatttgacccatagaaaattgtctttatagaccaaaaatggtcaaagatgagcaatttcatatctattacatgcttagtgttcactattttggggcatcttgtttctctccaggttgcgcattcatctgtttttgagtttaaaaccttgtatgtgcttaagaccaatagatattctcagtcactttttagacatttttgtcacctcagttttatcagaactagaaaaatcttccttaaaaacaactgaaaccttttcttttgcagtgtttcttttgctaatgatgaactaatattaacaacttaccttctaataactttgtctttgtaactcaggtttaaaagcattactccaccaatctcttttattctccattaaaagatattatttcctttataattcatttttattccttatttgtttagtgccttaagtctgtttctgtacagcttggagactgtaacttggaaaaatgtagatatattcattatatactatctcacttaaatgtgaattctgaagaagtttttctgagaaaataaattcgtcttgtttgagtgttccttctctgtctgctgtattctaccagggggacagaggaaagaagggcagagaaattctttcctggatttcatgaaatcactgaggccagagcaacagatcatttaacttttctttatcccgtgtatgtattactgaaaaaaatggtacataatagaatttgagtttatttttatctgacttcaggtacatagggacacttcctgtttaaaagaactctgcattgaattgtgcctttcataaagcaaaaaaaaaaaaaaaaaa

SEQ ID NO: 3218 - DNA, 777 bp, Homo sapiens
ggcagaggctcctcagaagggcgtgggctctccagtcttccacagtccccaccatgccctgttgccttaccgctgacgtagctcacccatcttttacttgcctggctaagatgcatggcatywcatttcctccttgttgcactgcagtcagtccctcactgcccccatctcctggaagaggagcataagctttgcaaggtcagccacttctctggggtcacactagttacatcaagacaggactccagctcatatgtgccagtgcagacactcttcatccacctggggccctgggcttgggacctggytccttgcacagcagargacccggaggctgagaggagcttgcggttgtgtcatagtcacctggccagarggaacgtgagcccctcccaagctgcagarggarggarcargcgtggctgtcagcaccgaggtagcagagaattaacattcttgtcagcagagaatgaagcaggaatataattaaaactttgcccttggaatagctgattcatttgaattttattccacacgtttgaaagaggaaagaaaatgtgaagacttgcagcctggttctcgcctggcctgggctggcccagctgtcaggcccggttcctttctgagcattcagtccactgatgttgactgagggccaggagagaccctcagcagggtattaccatatcagcctcctatcgctgctgggagaaattaccatgaattcagtggcttaaaacaacacacgagcctctctgagcctaccctggctcagga

SEQ ID NO: 3219 - DNA, 1788 bp, Homo sapiens
  misc_feature (12)..(12): n equals a,t,g, or c
  misc_feature (1490)..(1490): n equals a,t,g, or c
gtatgttcctgnattttattctctaaattgtactcaatttcatggtaattacatgaagaagttacctgcaattattcttaacactacatggtaattcactgggtaattgtgggtcatttatttcctgaagtcacgtgaaatccttagctggttgaatgttgcacagtatttgagaattacggtttgaagtgatttctgtgggagggaatcattgcaatgtatattctaaataaagtcatctaactattaaaaaaaaaacacccttcctaacccttcttttcttaaaattccacattcatccacaatctcatccctttgtagaaattcttgcctgaattctcaccaagttttgaattcctaaggtagccccgatctaggatgtgaaggctgcccagaaaaagtttatggctggaggagtatcatacagtgtctacatatgatagtacttacagattaggtcttkggatgctttaacacaaaagatttttgttatccttattagtcaaataacgctattcttttgtggttctagaccctggcttctatctccctgtgatttgttttaatgctgaaatgacttggctatccaaagcttctagtctagaggtctgttggttgaaggcagacatttccaagtttgttgaaataatacgaagctgactagcttacgtgaatgatgttgccctcatttgttttgggtgaggactcattactgcagtatattgatctcttcaccaaatgctttttctytttctgaataaatgctgtattagaggttctatttatatatgatttttaaaactttggtttccttctatccaccaaatactgtgaattgtttttccatttatttttcttagctaatgtaactttattcttcacttttttttagccctagacttcctagattttctgtggcattctgtaggacattgtattgcttggaaaaaaaaagatcaaaatcattckggggcaaakgctctattatccttatttatgacaagagaataatgaaattcataagaaattaataacattcagatattgctataaatgtacttgagtcattttcatttggggatagtaataatggctgtggcagctttaatggagaaacctgtgttggcctctttttctggcattaggatctcttgtcatagaactattggtaaagtacaggtttgatagcagagttcctgaattcagcatatcatcagaatttccatttaccttttgtcttttctttttatkgtattttttaacctttttgtttctattcctacctcccatgagtaacattgatttctgctgaagttagaatttgtgttaagaattgactttaaacttctgaaatagttgaatattagaagtggcttcagttgccatgaaatgattgcttttctttttctttttttttccttaaataaaaataatgcagccttatatatgtctcttcccctcaagaatgtgaatttaggctgggcatagtnactcacgcctgtaatcccagacctttgggaggctgacacgggaagattgcttgagcccaggaatttcagaccagcctgggcaacacaggaagactccatctctacttaaaatatttttgttttttagccaggtgtggtggtatgtgcctgtagtcccagctacttgggaggctgaggtgggaggatcacttgaacccaggagtttggggtgcagtgagctatgattgcgacactgcactccagcctgggcaacagagcaagaccctgtctcaaaaaaaaaaaaaaaaaaaaaactcga

SEQ ID NO: 3220 - DNA, 1398 bp, Homo sapiens
ggcacgaggcagctttggacatgtcgggcctcatagggagcatggggtgtggaagtggtggccgtgggctcaaaagctggctgcttagtttaccagctgtgtgatctcaagcagatcaccttcttcttcagagcctcagtttgcctgtcggtcatgccctgcctggaggccgtggccttgatcctgcttatcctgctggttccagacccaccccggggagctgccgagacacagggggagggggccgtgggaggcttcaggagcagctggtgtgaggacgtcagatacctggggaaaaactggagtttcgtgtggtcgaccctcggagtgaccgccatggcctttgtgactggagccctggggttctgggcccccaagtttctgctcgaggcacgcgtggttcacgggctgcagcctccctgcttccaggagccgtgcagcaaccccgacagcctgatttttggggcactgaccatcatgaccggcgtcattggggtcatcttgggggcagaagctgcgaggaggtacaagaaagtcattccaggagctgagcccctcatctgcgcctccagcctgcttgccacagccccctgcctctacctggctctcgtcctggccccgaccaccctgctggcctcctatgtgttcctgggccttggggarctgcttctgtcctgcaactgggcagtggttgccgacatcctgctgtctgtggtggtgcccagatgccgggggacggcagaggcacttcagatcacggtgggccacatcctgggagacgctggcagcccctatctcacaggacttatctctagtgtcctgcgggccaggcgccctgactcctatctgcagcgcttccgcagcctgcagcagagcttcctgtgctgcgcctttgtcatcgccctggggggcggctgcttcctgctgactgcgctgtacctggagagagacgagacccgggcctggcagcctgtcacagggaccccagacagcaatgatgtggacagcaatgacctggagagacaaggcctgctttcgggcgctggcgcctctacagaggagccctgaggtccctgcctgcactcgtcctgcctgcaagcctcccgttggtccccacagcagcagtgcctcggttcctctttggctgtcctcggggactccggctgaggcacatctgccacttttgaattcccggctggagagctggcaggaccctgtggctgggctgggaatggagctgtcagcactctgcgtgggaggcctgggcctgtgcctgcatcccgctcaaggctgccccagcctggggtccccagcctggctgctgctgggccctggataaagagaggccagtacaaagcccatggattttgggcctgtaaaaaaaaaaaaaaaaaaaaa

SEQ ID NO: 3221 - DNA, 1957 bp, Homo sapiens
  misc_feature (349)..(349): n equals a,t,g, or c
gtttctctgcaattatttggttcagttttaattttatctgtaacaatgatagtaattgctgtttcactttctctcttctgtgatgttgtttcctctgaatgtatgagctgctttactcctaagtttgctgacattgttgcaaatgcttatcagaatgaatcctatatttttatttaaaatgatcgtgtcattttcaatcaggcagcccatccaaacatgcggacctattatttctgcactgatacaggaaaggaaatggagttgtggatgaaagccatgttagatgctgccctagtacagacagaacctgtgaaaaggtaaaggcttgtagaaaaaatgatggtgattnccacttccattttattccatgccttgcaagtatttcactgtcatagtmcatatcattttaatagtcatggtatgaaatcattttttcctcagaaagcaaggatcaattcctgttctgaattaaattaatacacattttgttagtttgcgataccacctacatttttattccacttttcttctttttcttctttattcattttcacctatcggtgtactggggtgaatccagaatcctaacattcaaactgaatgttctttcttcttacagaattacctttaatttccggtgagtacgtttttaattgttaccttaaagctacacagatttttatcctttgagatagtgtttttaagattctaaatcttagaagagagtttatttttatgaagttaatttgtgtttttctgtaatagtgtgttgatgtttctaaagtgtgatgaattacagtaagaamctttgatartttcattttttcaacatttctgattaatttttattgtttttgtaatgaatgtctccagaaaatagttcgtcaagcatttagattgtttccaaatccacttcttggtgaattgtaccttttttatattgaaactccactactcagatyccttgataatatagataagtgctgttaaaattgacccatgtatttttccctgcttgaagatacgaatcattttaatattcttcagtatagctagttagaggaaatctgattctcagactacataaatacaagtagtataatgtgctttttaaaaaatatgtattcctgtaattcgaagaaaaaattatgatgcaagttaatttttcttccagtcagtgacagctgagcacatatcttatgtaagaaagatgctaatgtgcatcttttttccctcttcttttttttccctcttctcaggaaattagggattgttmcagtatacatctagtcctttgtttttcttattctagtgtgcattttaataaagtcttggctttttggctaaaagacttaggttgatgctgtgtatttgtgctatttttgtaaatatcaagtctaaatcaagttacccaatcactagtaattagagctggggaaaaactgaaaagaaaagagggtctaggatatagctctaggacatctatttttaagaaaaaccacttttgccacatgcatattgcaggatgagagcagatagaaggaaaatctgtttttggaattgcatgtgtaaaaattacctgagtagcataaagatgaggtggttagcactgataacgagagaaaatgtgtaggtgaagagaattcatttaaaatcttcaggctgagcatggtggctcacacctgtaattctagcactttgggaggttgagggatcacttgagcccaggattttgagatcagcctgggcaacatgatgaaacaccatctgtaccaaaaatacaaaaattagctgggcgtagtaccacactcttgtagtccctgctactcgggaggctgaagcatgaggatcacttgaatcaggaggttgaggctgctgtgagctgtgactgtgccactgcactccagcctggacaacggagtgagaccctgtcaaaaaaaaaaaaaaaaaaactcga

SEQ ID NO: 3222 - DNA, 978 bp, Homo sapiens
  misc_feature (166)..(166): n equals a,t,g, or c
gaattcggcacgagtccacttttccttcttcctgttagagggaagttgtcccctgttgccatttctgaaacttgggcggacaatgtcgttattgtgttacaaacgatttgcgtctccagggcaggagttgggtgatatttttctgggagcctgtgccagggcgtancagttgttatctcatggtttctgagtgaatgagtgagtgagtattaaaacttcatatcaacatggagcctataacacagtggttctgaatctttcttgggggggaaaagaagagatacaagacccctagagagtatagagagtatgtaaaagggaagaatccttccccaaaagggaatgcacatatttacaatattgtatccaatttcagaaggtttttttaaaatttttaattttattgtttttttttgagacacggtctcagtttgtaccccagcgtggagtgcagtggcatgatcttggatctcggctcactgcagcctctgcctcctgacctcaggtgatccacccacctcggcctcccacagtgctgggattacaggtgtgagccaccatgcctgaccatgactagtgttttgatgtgtggatttactacaatttatttgaccattctcctatcaatggacactttagttgttttagtacacctccctgtcccgtcacaaatcatactttgtaatgtttctggtggatatktcttgtaaccttcacaagtttatctgtagagtaaatttctagtttcaggattactggattggaagatgcatgcatttaaaagtgtgattgctgttgtcaggttgtcctccaaaagtgtcccctcagtttgtacctgtatccataggtttggagagtgtctgtttctccataccgtctcatctgaaatgaaaatttttacatgtttgctagtctgaaaggtgaaaaattgtatcttgttttttttttttttttttttttttttgagacggagtcttg

SEQ ID NO: 3223 - DNA, 1438 bp, Homo sapiens
ggcacgaggcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgattggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcactccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgcaaaaaaaaaaaaaaaaaaaaaaaaaaaaa

SEQ ID NO: 3224 - DNA, 1346 bp, Homo sapiens
  misc_feature (707)..(707): n equals a,t,g, or c
  misc_feature (998)..(998): n equals a,t,g, or c
gggcagmgyaaacacctcttcttataaacatggccctgctttagcaacaggtctccattatgaagcaatttggatttggacatcctatcaagttacttaaaactaaactctgccgtatagtgttttacttggtattttttgtgtggccacagtctagtgtgatcagagaagccacacagacataaattcccagtcctgattccattgattattagatatgtacttaccctgaacatctgtaagatggggagtaatgatgtttaccacaaagagttagtgtaaggattcgatgagagaacttgcatttgagccatctggagagaatgttagttttagcactaacgatcgtttataatactgctgaggaggaaggactgacatcaccctgcttgagaatctagtatatgttgggcattccytatccattcatgagcctgagagtacttgagawgttttgatcttggacactgytgtgcagctttaaggatgatgagggggaaatggaaagagtcytgaagggaccagtgtcagagacagatagaaaagggctgcctgagccgggcgcagtgactcacgcctgtaatcccaacactttgggaggccggggcgggtggatcacctgaggtcgggagttcgagacccgtctaaccaacatggagaaaccctgcttctactawaaatacaaaattagccaggtatggtggcanatgcctgttaccccagctgcttgggaggctgaggcaggagaattgcttgagaggcagaggttgttgtaagccgagwtcgcgccattgcacgccagcctgggcaacaagatkgaaactcccatctcaaaaaaagaaaagaaaagggctgcctgggtccctgggaagacccagctcccctctgtatcctagccaactccttaagtgcacacaacctcagctgaccacataggtggcagtgatagcaaatggtgaggtgggtgggggtgggggtcctgcagctcactttctgtnctgcgtaataagggagagatcagagatgcatagacttttaaactggtacggttcttagagatggtccttggccttctgttgttgttgttgtttttttctttttcttcttctccttctccttcttcttctcttctccttctttcttcttttttttttcagagtcttgctctgtcaccaagactggagtgaagtgatgtgatctcggcttactgcaacctccacctcctgaggtcaggagaattgcttgagaggcagaggttgttgtaagccgagatcgcgccattgcacgccagcctgggcaacaagattgaaactcccatctcaaaaaaaaaaaaaaaaaactcgtag

SEQ ID NO: 3225 - DNA, 2024 bp, Homo sapiens
acgcgtccgttgtgtgggacaagctgctcccgacagaaggatgtcgctgctgagcctgccctggctgggcctcagaccggtggcaatgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaaggactcgacccagatgtcggccacctattcccagggctttacggtatggctgggtcccatcatccccttcatcgttttatgccaccctgacaccatccggtctatcaccaatgcctcagctgccattgcacccaaggataatctcttcatcaggttcctgaagccctggctgggtgagtacctgcaggtgaaaggggttggggacaaccttgcggggagggtaggggaagtgctgctcttgcccattgtccttggctgccctactaggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtgctgccttccccattcaccaccaccacccccatcctctacttttgtgtgtgtgtgtgtgaattccaaggttcctagtggagggggcagggttttgatgaggaaaatccaacatcacctcaccccaaaacacacacaagtgtctctccaaggctgctggacataggaaatcccactggcaaaccttctttgtctcacctgcaggtctacgaccccttccgctttgacccagagaacagcaaggggaggtcacctctggcttttattcctttctccgcagggcccaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaggcttgcagtgactttctgacccatccacctgtttttttgcagattgtcatgaataaaacggtgctgtcacctcaaaaaaaaaaaaaaaaaaaaaaaaaaaaaaaaaaaaaaaaaaaaaaaaa

SEQ ID NO: 3226 - DNA, 956 bp, Homo sapiens
aattcggcacgagctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtcctgcccgagatttgcttctgtctttggtagtcccggstccttctcagccgaggtgttgctcacatcctgaagacacgatgaaagcattctgcaggagggagcttgaactgaaggaggctgcgcactggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggstctcaccgccattgcaccagtatggtggtatgtactcacaaagattaagaaagaaatgtattctgaytaaaaaaaaaaaaaaaaaaactcga

SEQ ID NO: 3227 - DNA, 1966 bp, Homo sapiens
gtcgcgcctgcaggtcgacactagtggatccaaagaattcggcacgagctggggagcgggactsgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggactgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacrcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaaaaaaaaaaaaaaaaaaaaaaactcga

SEQ ID NO: 3228 - DNA, 1392 bp, Homo sapiens
  misc_feature (129)..(129): n equals a,t,g, or c
  misc_feature (149)..(149): n equals a,t,g, or c
  misc_feature (339)..(339): n equals a,t,g, or c
cagctcagctctgcgctgctgcacgccaaccacacactcagcaccattgaccacctggtgttggagacggtggagaggctgggcgaggcggtgaggacagagctgaccaccctggaggaggtgctcganccgcgcacggagctggtggntgccgcccgaggggctcgacggcaggcggaggctgcggcccagcagctgcaggggctggccttctggcagggagtgcscctgagccccctgcaggtggctgaaaatgtgtcctttgtggaggagtacaggtggctggcctaygtcctcctgctgctcctggagctgctggtctgcctcttcaccctcctnggcctggcgaacagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaaracgscctggaaggcctgctcttcctgctgctcttctccctgctgtctgcaggagcgctggccastgccctmtgcakcctgccccgagcstgggccctcttcccacccaggaatccaagcgctttgtgcagtggcagtcgtctatctgagcccctcctcccggctggactggagcctggctcccctcttcgttccttccctggctgccggagagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggacatgagtccccctgctgcccctgccacatcccagtgggctctgaccccctgatctcaactcgtggcactaacttggaaaagggttgatttaaaataaaagggaagactattttacaaaaaaaaaaaaaaaaaaaactcga

SEQ ID NO: 3229 - DNA, 990 bp, Homo sapiens
aattcggcacgagtggacaaccatcagggagccaggacacagaggggcagagcaagtcagcattggcgccccttcctcagatccctatcatcttgggaaacagtagcccagaggttcaggaagatgttaacttaaatgttcggggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcasggtactgcttggctgtgccgggtggtatggagcgactaaagagagcagaggcacgytcttgtttgttggagatgtggccttggaacacamcttcgtgaccctgaggaagaattacagaggttacaacgagccagacgactattctacacagtggaacttggtcatggagaagctaaagtgctgtggggtgaataactacacagatttttctggctcttccttcgaaatgacaacgggccacacytaccccaggagttgctgtaaatccatcggaagtgtgtcctgtgacggacgcgatgtgtctccaaacgtcatccaccagaagggctgtttccataaactcctaaaaatcaccaagactcagagcttcaccctgagtgggagctctctgggagctgcagtgatacagttgccaggaattcttgccactttgctgctgtttatcaagctgggctgacacccaggcctggagaagatgagacacctgggcccatctggctgctggagattcagtctcagttttatttctctgtggcactcactgcttctggaggggagactgttaataaaagatttgggaaaaaaaaaaaaaaaaaaaaaaaaaaaaaaaaaaaaaaaactcga

SEQ ID NO: 3230 - DNA, 1451 bp, Homo sapiens
  misc_feature (937)..(937): n equals a,t,g, or c
  misc_feature (965)..(965): n equals a,t,g, or c
  misc_feature (975)..(975): n equals a,t,g, or c
gccagttcactcctcggctggagacactaggtgtcctgcccctaatctcaccagagccacctcataaaccctgcaagctctgcgaagggcagctgggcacagctgaaagcccagccaccagcccatgtcctgggtgggactgggcaggaggggccacctcctactgctgatcaacccgagagccctggctgggatccgtcttccttcaccaacgggagctccggccccagggccctgcccacctctgtgcaccccacactgcagcagggagcaccctgcaggaggaactgggcaccctgcaggggtctggtggagacgaggatgctacggaggcagctgccccatgggaccagtaagagggatcttgggtgggcttccctgcagagaggaagccctcaggagacaccacagtaagccatgctggagacctggaggccaggcccgtcamctggggagctggccactaacagcgggcagagagcctcccaggacagccagcacagccccccacacgtccgagcccacctcctcatttccccgcttcccgcgttcccaagcatgggaggacctgccggacgcagcgcaccatytytcctaacagagaccaagtctgagcttcaacgcttgcgcagacgacaggcacgtgcaagcytytcytytccagcaggagagcccggagcaggacacagcgaytctttcaactgcgtcccgacaaacggtcagccccttcgctcctgcagtttatccaagctcaggaggagctttctaaagagaacacagggagacagctggctgccagagaagcagtcctggctctggaaggctccacccagctaacagggcctgtgacacaggtggcagccagcaagacccactgcagcggcatggccctcacagcctcccctgtccctgtcctgggagcagccccggcaaagantcctacccagaacaytccaggtcagganggcagggccntgargaargtgargacatcctggararctgtggccaccaaggtgctgcacggcctggaggtctccacacatctgggcaaacggaagctttctgggaggagctggctcccaggccctgctctccacgccaccccatcacagtcgcacacacagacaggctcccagattgtccaccctccacagggagaagtcagggaggtgggcaggggacggggtcagccaccggctcagcctgtgcacgcccatccctcccagcagcacccctctccggcccacctggctggcctgagtctgtggactggcactgcctgatagaactttcagtaccttcagtgcccaaagggcgcgacgactagcccttaaaagaggctggagcccctgaggaagcgggtctttaggcaaaaccaccgcacggcagagcagccacaggacagatcaatgtcttctgcgggaaaaaaaaaaaaaaaaaaactcgta

SEQ ID NO: 3231 - DNA, 972 bp, Homo sapiens
  misc_feature (564)..(564): n equals a,t,g, or c
ggcacgagccaagtggtcccccagacaaggctcaggatgtccacatccactgcatcctggaccctgtgcaggtgaagatgtcccgacccacgcatactcctctttcgcctgccaccatttctccaaccatcacagtagcagtcttcttcgctgtgttcgtcgccgccgccgccgccaccgccgttgtcgccgtcgctgctgcaaccaccagcagcggscgcagaactasagacaaatcccccatagccactcagtcttccgtaacccacatcgcagccaaaagatgtcacaactacaccgagtgcctttctttgatcaggargacccggattcctacctggargargargacaacctgcccttcccgtatcccaagtacccacgtcgcggctggggcgggttttatcagagagcgggcctgcctccaatgtggggctgtggggccaccagggtgtatcctggccagtctgccaccaccctctctctacctgtcacctgagctgcgctgcatgcccaagcgtgtagaggccaggtctgagctgaggctctgcccgcctggcgtcntctgactacctctgcctccctcacggtgttggacgaggcctcccatcaacggaccccagctccaagctcagtgctggtcccccattcctcccagccctggcccaaagtccaggctgcggaccctgcccctcccccgaccatgtttgtcccactcagccggaatccagggggcaatgccaactaccaggtgtacgacagcctggagctgaagcggcaggtgcagaagagcagagccaggtccagctcactgccaccggcttccacctccaccttgaggccctytctgcacaggagccagaccgagaaactcaactgaccagcaggcggatgtggggtgtggggcagggcatggagggagaggaataaagagaaacagagtccaggaaaaaaaaaaaaaaaaaaactcga

SEQ ID NO: 3232 - DNA, 890 bp, Homo sapiens
  misc_feature (280)..(280): n equals a,t,g, or c
ttcaaactagcaaaaaatgtatgaaactatgaagctcgatgcgtgtratcatcagcagaggccgacgctgcaggcagggccaaagcttctgaccctggcccccagggaggaacccagaggccagtcagggaggggcagcgagctcacggccaggcagcgccacagcactggcgaccctcagggagaacaggcactacccagggctggatgcgtaacgggccccccggccacaccccaccgcccatcagagccgcagctcctgagaacgcatccggatgcnaggccaaagtcagccatggcacaaacatttgtgcatcaaggtcctgttgctctgcaacaactcaccacaaacagaagggtggaaacctccatgtcatcggacggccacggscagaatccaacgccatctccctgggctgatgtctgtgcaagcagggctgatgccgtagcttttccggcttctggaarctgccacagcccctggctcatggsaccatcctcacatcctctgaatccacattctcctctgaatctcccgcctccctctttccactgtaaggaccctgtgatgacactgcaccctcagaccctggtaacccagggtcatctttccacctcagggcgtctgacttaagcctgcctggagggtccctgtggtcacattcatgggttccaggcttcagacacggccactttgtgggatcattactctgcctaccacaccatgtggccctgtgtgtgttttcagggggcatttgcgcytatatgcaaataatacatatatgaataaacgtgtgaatggtggtcacgtaggagarggcatctgtatggggccacacctgtaaaaaaaaaaaaaaaaaaaaaaaaaaaaaaaaaaaaaaaaaaaaaaa

SEQ ID NO: 3233 - DNA, 513 bp, Homo sapiens
ctgcaggaattcggcacgagggaacaactccatgtttttgtaaaggcctagagaacatatatccagtgcctttcctttttgcctttgtattcatcattttggcaaattactggaagatgacggttctggccaaaaggctggttttgtttttgggtcacattttcttgcttctctgcgttagaatcttggattagatgatggacatggtgaagatctcagcaacctcattcactagaagatcatgtggattggaatcatacaatggggaacaaatggaaaagagtacttttgaaatagtgctggagaccactgtgaccacagaatgtcaagacacgtgctgccattactgttactatttggaaaatacattcttgtaaatgcaaccttagggggtttgagggggaagtctgttgggaaatgaattgcaagaaaaatattacaccctgaaaaaaaaaaaaaaaaaaaaaaaaaaaaaaaaaaaaaaaaaaaaaaaaaaaaaaaaaaaaaactcga

SEQ ID NO: 3234 - DNA, 593 bp, Homo sapiens
ccacgcttccggagctcttacttctccagcaacgctcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtctttttttttttttttttttttttggtatattgctgtatctactttaacttccagaaataaacgttatataggaaccgacaaaaaaaaaaaaaaaaaaaaaaaaaaaaaaaaaaaaaaaaaaaaaaaaaaaaaaaaaaaaaaaaaaaa

SEQ ID NO: 3235 - DNA, 615 bp, Homo sapiens
ccagggagacagcagcgtggtcagagtggtaggagctggccatcggtgagagctgctccatgcctggctgctgggtgctagagcttgtggaccactggcttgcctcactgtggttggtggtggcggtgacagagtgtgcagcacgaccagagtggcttttctggctttgcccgcccagctgctccatgccaggaggaggaggagacacctagagcctgcgacaccatggctcgsctcgctgcagtgtaggktctacccatgtaacagatgaggaaaccaaggagcacagttatttactaactcgcacaaggttcgaggccgagctcagacctgtggagcagaagctgagtgcgctgcagtccccgctggcccagargcccttcttcgaggtgccctcaccsctgggcgccgtggacctgtacgagtaygcatgcggggaygaggacctggagccgctgtgacgccgcccgcgagaaacgccgcrcggggccgctccccacgtgccaccaccgggccaccgcggctcgtgtaaaaactgttgtggaaaatgagtgcgtttgtacggaatgataaacttttatttattcacaaaaaaaaaaaaaaaaaaaaaaattc

SEQ ID NO: 3236 - DNA, 1322 bp, Homo sapiens
  misc_feature (11)..(11): n equals a,t,g, or c
  misc_feature (690)..(690): n equals a,t,g, or c
  misc_feature (719)..(720): n equals a,t,g, or c
ctragcaactnagtgggatcccccggrrctggcaggaattcggcacgaggtggaatctgtgacccagaagtaacaaactcctttcttggagagcagttaggtattccattccttagtccatatgccaacatttaaaaaggccaaaaccagaggcctagaaaatgtatctggaagttgcagtgagaccgtttttgatcattgtggccttcctggggctcagtttcctcgctttgcaaatgccattttggcagggatctgctgtggggcatctccgtgcaggtggagctggagttgcgcatctttctcaggctggcatcatacaggccccagtgcactctggcagggaggggcagccccctcctggatagccccgsccaaggccgggargactgtgaaggggggatcccactgcctgacctcagcctgtcgggccccacagcgcgtctctctgtggactggtcgccggcttcctgtggcctgtgtgtcctccgagtggctggagctttggaaccctattctgtagcttggagctcctgagcctcaaagggcaggggcctggttccttgcccatccttgcccagcctgatggcctgtgcttgtggactgtacatgggcacctgctttaacacctggaggagtaggggctaccaagaagcatgtggctctgggcctccctgggagagtcactcngcggcaggagaactgagtgggacacatcnnggagtgtctgtctcatggacscctkttggcctgcagcctggagagggggcctgaagtgtgtgttccatgctcttgacccccagkaagcactcgcctctgttgaaagcctcgtgccgcagagcgcgattgctgtcccgggtggacggccatcacgggctccttgctccggcgatgccagcgctcctggtgttgtgtgtggctggctcccccttgtctcagccctgggcttagagcaggccaggtgctcaggcagtggttttgttgcttgaaggggggtgtgtacctggctgcagcctgtggagagcgtgagtggctggcagaagcaaaggcgggctcttgggagatgagagcaggcagccggcctggaggcttccatggggctggtcagctcctgctggctcttcctggcacaaatccacgctgggctgggtgccttggctcacacctgtaatcccagcactttgggagcctgaagtgggaggatcgcttgagcctgggagttcaagaccagcctgggcaacactgtgagaccctatctctatttttaaaaataaaaatataaagataacccttcctycaaaaaaaaaaaaaaaaaactcgag

SEQ ID NO: 3237 - DNA, 1500 bp, Homo sapiens
  misc_feature (71)..(71): n equals a,t,g, or c
  misc_feature (73)..(73): n equals a,t,g, or c
  misc_feature (755)..(755): n equals a,t,g, or c
gcctgaagggtcgtgaggctggggcgggacccggcaccgctggggcgccaggccgtgaggacgccaatggnangcakcgtggacgaggaggcrctcaccagctgtacctgtgggtagacaacatccctctgtcccggcccaagcgaaacctctcccgggactttagcgatggagtccttgttgcagaggtcatcaagttttacttccccaagatggtggagatgcacaattatgtcggcacgagctctctccagcagaagctcagcaactggggtcatctgaacaggaaggtactgaagaggctgaacttttcagtaccggatgacgtgatgcgcaagatcgcgcagtgcgccccaggcgtggtggagctggtgctcatcccgctgaggcagcgcctggaggagaggcagaggcgcaggaagcagggcgccggctccttacaggagctggctccccaggatggcagtggctacatggatgtgggtgtatcccagaaggcccgaggtgaargtgtcccggacccccagggagggggtcagctcagctgggaccggccgccggcgcctcggcctccagcgtataaccgggcgttgcagggcgaccccagcttcgtcctccagatcgctgaaaaggagcaggagctgttggcctctcaagagaccgtgcaggtcctgcagatgaaggtaaggcgcctggagcacctgctccagctcaagaatgtgcggatcgaaaacctctcccggcggctccagcangcggarcgtaagcagcggtgagcggcggcccgggccgcgcggggacgcccgggtacccgccagagccccgacgccgcgccggacccacccaccgatggatagaccattgggagggcggagcccgctgctctcacgagcctgctggggcccgagtgccctccttccttgggatgggtgagcgtggaggagatgggacaggaactctaggagcgcaggcccgggactgagccgcctcctaccactccggagatccgggtcaggagaatggaccgctttccagagcccagaagccacgtgcagagacctagcctgtcccccaaagcagtgtccaacaccttgggcccggccttgcatctcccggcgctgggccttggggggcggtcccttggctctgtccacacccccagaatcaggtccccgcccagctccgaggacggcggcgtctccatccaggctagttccccatgccctcagccatgggggaatctgtcccgggccgctgaggggctcccctgcccctcctgggagcttacctgggacccacctcggcgacggagaccgcagcagctggagaggaaggggtgaggcgtgggatcgccaggagtagggaggacatcgacgatgtgcccgtagcagtcgcccctccctcctcgcgcacggggtactgaggcggaaggtttgaaggttacggctcagggctgccccattaaagtcagtgttgtgttctaaaaaaaaaaaaaaaaaa

SEQ ID NO: 3238 - DNA, 1536 bp, Homo sapiens
  misc_feature (687)..(687): n equals a,t,g, or c
  misc_feature (1196)..(1196): n equals a,t,g, or c
ggcacaggccaacttagtttgagttcttcttctggactctgtatgtccttgtgtgtaccctatgccgttcacagtccgtactctctctgtgarattggctgtctaatccaggtggatcaggaggtgctttgtggtttttttgcaaagaaatgaagtctggcaagcaaacaatgattaaacatgtttcgattcgtgacttgtcttttggcgaaatgcaaaggtgggtgtgcattcttgaattcaaagaaaatctctttcaaatcccctcatcccttgttgctcttctaaatactctctttctagatatcttgcacccccaaaactccctcagcccccatggcagcttttctctctcctctctctctttcccgcctctccctgtctcctcacttcagcctttcctctttcttagatctttattatgtagataaaaacccctccaacctccttagccttctctccattgcatcccctacccgaattatcctcaagaaagaggccaggatccgacacagcgatcagaaatcctcctcccttasaagcscaggggtgagggagttcaggaatattcatacactggtaatccttgtccctgttacagtcacttccttgtatcaggacccttgttactatttacagactattttccatctctcctaatgcaattgctcaaagggcactttaagnataatcattatccattgatgttttttggaggcttttattccctccaataagttctgccgaatactggccgctggctctatttgttaaacaatggagggctttgttccgcttttttttttttttttwttcwtaacctgagctttctgcccacccttagtatggggccaaagggaagatttttatgccaccccttttggtgagaagagtcacttcctgattagtgtttgggctgaaaatgggtccccctttgggaagaaacatgggtgcagtgtacttcctgtgtcacaggattaacagctcctgccccactcccaaggaggcagctcytcggggcagttcytctttgagaatttcatggtcattaagaagcaggytcccagggaccccagagtgggaacctttgactgaagtcaccacagtgggtgtaagataaacataagagacttttctcagggaagatttggaacgaagaaaaagagtaaaaagttcacatggaccatggagtgttntggaaaagggcccagaaagggaagctgtggctaagaagataaactgcctgattgcagagacccaggagaggggatgaaatctctttgtctggtcacatttctcwwtaatgatkytccacatgtacaaagctagccagtttaccaagtgcttccacacacattgcttcattctgtgtctcttaagcagattgactccttggaaaagcctcacgtctggcattctgcacctgcccatcaccagtttggccttggtctgcttggctggttgggtctccccatggtgagctcccatggtatctcctcttcacctttatatcactcattagacaccggtgacaac

SEQ ID NO: 3239 - DNA, 660 bp, Homo sapiens
  misc_feature (393)..(393): n equals a,t,g, or c
  misc_feature (401)..(401): n equals a,t,g, or c
gaattcggcacgaggagatgcacatggccctgaacaaccaggccaccgggctcctgaacctcaagaaggacatccggggcgtgctggaccagatggaggacatccagctggagattctcagggagcgggcccagtgccgcactcgagccaggaaggagaagcagatggcaagcatgtcgaaagggaggccaaagctgggaagytccaagggcctggcaggccagctctggctgctgaccctgaggctgctgctgggcgccctgctggtctggaccgytgcctacgtgtacgtggtgaaccccacacctttcgaggggctggtgccamccctgctgagccgtgccaccgtytggaagctccgggccctgctggaccccttcctgcgcctcaaantggacggnttcctgcccttctaggccaraggcccagcggccccagcaaggaggccaggcgaccagcactgccccggatgcccagtggccgtgccagccccctgcacatggcaccactgtgcaccatccttgccagaagctgcagagaagggtggaggtggggtctgtcctgagggctgggcctgtggctggacatagagtcatgacataaaaaaaaaaaaaaaaaaaaaaaaaaaaaaaaaaaaaaaaaaaaaaaaaaaaaactcga

SEQ ID NO: 3240 - DNA, 833 bp, Homo sapiens
  misc_feature (35)..(35): n equals a,t,g, or c
  misc_feature (140)..(140): n equals a,t,g, or c
  misc_feature (590)..(590): n equals a,t,g, or c
ggcacgaggagaacttggcaggctctccccatggnagtcttattcctcctcctgttcctatgtggaactccccaggctgcagacaacatgcaggccatctatgtggccttgggggaggcagtagagctgycatgtccctnaccacctactctacatggggacgaacacctgtaatggttctgcagccctgcagcaggctccttcaccaccctggtagcccamgtccaagtgggcaggccagccccagaccctggaaaaccmggaagggaatccaggstcagactgctggggaactattctttgtggttggagggatccaaagaggaagatgccgggcggtactggtgcgctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgagggccgtgttcagtccttctggggcagtgaggctgccctgctcttggtgtgtcctgggganggggctttctgagcccaggagccgaagaccaagaatcatccgttgcctcatgactcacaacaaaggggtcagttttagcctggcagcctccatcgatgcttctcctgccctctgtgcccttccacggctgggacatgccttggattctgatgctgctgttcacaatgggccagggagttgtcatcctggccttcagatcgtgtctggaggcagaggtccctggggttccagcagaggaaccga

SEQ ID NO: 3241 - DNA, 1943 bp, Homo sapiens
ggcacgagcctgaaagtccgtggcttcattcttgaagtcagcgagaccacgaacccaccggaaggaaccaactctggacacagtggcatggtctcggctctctgcggcctctgcctcttgggttcaaacgattctcctgcctcggcctcccaagtagctgggactacaggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcagtgacagattctcatgacttcctggattgttgagactttcccatgtgaaccatagttcattgcttctcacaacagcagacagctcttggtgctccacagtgctgtagggcgctgtgacacatgccgaagagcctctctcttctggaccaagggttttgctaagttgtctggaggaggaaaacatgggtttgttcttaatccttcctcggcttacttgatatagaatggagaagaccaggagcaactggaagctggaaacaagagcagatgagtcagaagtttggagacaggcaccaaaaagtccatccagcgtccagggaatagttgagagttaaacaccaagaagagtcaagccaagcctggatgagtcaggtcatgcctgtaatccctgcactttgggaggccatggtgggaagattgcatgaacccgggagtttgagaccagtgtgggcaacatagtgagaccccatctctataaaagaattaaaaataaaagttggctgggtgtggtggtgcatacctgcggtctcagctactcaggaggctgagacgggaagcagaatattacagaattatagtagtattaaaaataatggcaaaacccacagttacttttgcaccaacctaatagtagtgataacagggtcaggaagtgagagaagccagaaccatatgacatcctggtccaggtactggcctagttgtgaaattgccccacatataggtggccagccatcaagatcccagttttggagctgggcgtggtggctcacgcctgtagttccagtgattcgggaggctggggcaggaggatcacttgaggccgggagtttgagaccagcctggacaacatagcaagagaccctgtctgtataacaagtttaaagattgactgggcgtggtggtgcatgatggtagtcccagctactcgggggaccggggcggaaggatcgcttgagtccagattccaagctgcagtgggctgtgattgtgtcactgcactccagcctgggcaacagagcgagaccctgtctcttaaaaaaaaaaaaaa

SEQ ID NO: 3242 - DNA, 574 bp, Homo sapiens
  misc_feature (565)..(565): n equals a,t,g, or c
tgtgagcggataacaatttcacacaggaaacagctatgaccatgattacgccaagctcgaaattaaccctcactaaagggaacaaaagctggagctccacccggttgcggccsctctaraaytaktggatcccccgggctgcagaattcggcacgagcccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcacaaaaaaaaaaaaaaaaaaaaactccaggggggcccggtacccaattcgccctatagtgagtcgtattacaattcactggccgtcgntttaaaagt

SEQ ID NO: 3243 - DNA, 1032 bp, Homo sapiens
ggcacgagctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatgagtggactcctcggcgctcagtgtcaacactctggtttagcaataatgggtttaaaaacaaacaatttgatccaagcaggttggggaacatattggtactgtacattctctttctagtttagtaaaagatgtgcaaaggccagagagggccgaaaatgaaaaaaaaaaaaaaaaaaaaaaaaaaaaaaaaaaaaaaaa

SEQ ID NO: 3244 - DNA, 1068 bp, Homo sapiens
gcaggcatgagccaccgcacccggccacaagtgtctgaacatttataatatgagaattatccctgattttccaaggacggaactgaaggccctcccgactaagaaggagacttaaagcgcctttttcagcgtggaagacaagactcgcgggcgctaaaggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctcaaaaaaaaaaaaaaaaaaaaaaaaaaaaaaaaaaaaaaaaaaaaaa

SEQ ID NO: 3245 - DNA, 1139 bp, Homo sapiens
  misc_feature (7)..(7): n equals a,t,g, or c
  misc_feature (133)..(133): n equals a,t,g, or c
  misc_feature (968)..(968): n equals a,t,g, or c
  misc_feature (1139)..(1139): n equals a,t,g, or c
agggcanacttacagagatatcatatgagatcacccctcgcattcgtgtctggcgccagaccctcgagcggtgccggagcgcasccaggtgtgcttgtgcctgggccagctggagaggtccattgcctgggangaagtctgtcaacaaagtgacatgtctagtctgccggaagggtgacaatgatgagtttcttctgctttgtgatgggtgtraccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttncccttggcagtgccccacatcctcttattcctacatccctttctcccttccctcctcttgctcctcaagtaagaggtgcagagatgaggtccttctggactaaaagccaaaaaaagaaagaaaaaaawaaaaaaaaaaaaaaaaaaaaaaaaaaaaaaaaaaaaaaaaaan

SEQ ID NO: 3246 - DNA, 1041 bp, Homo sapiens
agagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggtt

SEQ ID NO: 3247 - DNA, 1339 bp, Homo sapiens
ggcacgagagcgtgacccagctgcggccggccagccatggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccggtgagatggagtgggtcacacctggcaagctggaagaaagttccctggggatgggagagcgggtgggtgctgccaatctccagctactgtggccacaccccacctggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcacagaaatcacctgctgcatcctgtgctccgcagctgggccggacctctgcccgcaggtttctatgctgtttcttagcacagaatccagcctagccttagccgcagtctaagccctgcttggactaggactccttgcttgaccccatctctggttcctgccctggctcctgcaccagccccagctcctgcctacatccaggcagaaagatagcaggggctcttggaagacgttccgtgctgtgacctccgagccctcctggtgggaagacagctggaaaggctgggaggagaagggaggggttgggggttcccaggagccatgcgtggcctgcagagtccattccatcatgatgctgtgcccgctatgggctgtgtccatgaccagaggctggagtgggggtgtgttagagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctggaaaaaaaaaaaaaaaaaaaaaaa

SEQ ID NO: 3248 - DNA, 2058 bp, Homo sapiens
  misc_feature (69)..(69): n equals a,t,g, or c
  misc_feature (161)..(161): n equals a,t,g, or c
tcggccttgcttttgtggycttcctctgtggccagagcgttttcatcaccaagcctcctgatggcagtnccttcaccgatatgttcaagatactgacgtattcctgctgttcccagaagcgaagtggagagcgccagagtaatggtgaaggcattggagtntttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcrgcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttccttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggattttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaawaaaaaaaaaaaaaaaaaaaaac

SEQ ID NO: 3249 - DNA, 1380 bp, Homo sapiens
  misc_feature (1186)..(1186): n equals a,t,g, or c
ggactgcgcggccgttggggtgcagcggcgccagtcggcgacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggaratcctggccaaggagctggaggagaagagtgaccgtctgctcaaggtcctcttcctggtgctgggctamaccgtcctggccgggatggtcttcctcaagtggtgagcggcctcgccattgtccctgccgccggagcccgcgggagccccgggccggacacaggcgngtcccccggccgcgcgtcccccaagagcgagcacttggccctgggccaccacctgtgcacaaggggcctcccgggaccaggctgtgcccccgatcctacaccctgagcctcagagcactgctactttttaaaatacttctttctcttaaaagtctttaccaaaaaaaaaaaaaaaaaawaaggggggcccggta

SEQ ID NO: 3250 - DNA, 1008 bp, Homo sapiens
ggcacgagcagacctgggctcgagaccataactgtttggctttaacagtacgtgggcggccggaatccgggagtccggtgacccgggctgtggtctagcataaaggcggaccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtccttgaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaaaaaaaaaaaaaaaaaaaaaaaaaaaaaaaaaaaaaaaaaaaaaaaaaaaaaaaaaaaaaa

SEQ ID NO: 3251 - DNA, 1131 bp, Homo sapiens
gaattcggcacgaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgytcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctgcagcggccccgggtgtggtttctgcgccgcgggagggggagctgtgcc

SEQ ID NO: 3252 - DNA, 812 bp, Homo sapiens
  misc_feature (24)..(24): n equals a,t,g, or c
  misc_feature (81)..(81): n equals a,t,g, or c
  misc_feature (90)..(90): n equals a,t,g, or c
  misc_feature (105)..(105): n equals a,t,g, or c
  misc_feature (751)..(751): n equals a,t,g, or c
taacacttttaatgctttccgggnttcgttatgtttgttgtggaaatttgttgagccggattaacaaatttcaccacaggnaaccagctnttgacccattgattnacgccaagytcgaaatttaacccttcactaaagggaacaaaagctggagttcaaccgcggttggcgcccgctctagaactagtggatcccccgggctgcaggaattcggcacgagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcccctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctanggcccttggccaatgtgattaaagctgccatcttgaaaaaaaaaaaaaaaaaaaactcgag

SEQ ID NO: 3253 - DNA, 1145 bp, Homo sapiens
ggcacgagcctgagcccccagaatggcacctgggcagacaccttctctctgctcttggctcttgccgttgccctctacttgggctactactgggcatgtgtgcttcagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgcctatcctatggtaagacctgcaggcccgtacaatccgccagtttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcctaaaaaaaaaaaaaaaaaaaaaaaaaaaaaaaaaaaaaaaaaaaaaaaaaaaaa

SEQ ID NO: 3254 - DNA, 1324 bp, Homo sapiens
gccgcagaggttccttaggagcaccccgcgcggcccgcgcgagcgcgcctgcgcgtcgaaccccacccccttgccggcgggccacggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactgggaaaacaca

SEQ ID NO: 3255 - DNA, 1226 bp, Homo sapiens
ggacgaggtatagtatattaatggctttatccgccatttaatgtggttcccatgaggtttaggtagaccatagatactgtttcaattagaacacttcatgaggatttagtttctctgtctatgggtcctgtatctgaactctccatttttattcttttgtttgttttttgttttgttttctccctgatgcctgatatcagaagaactctccatttttggcttcattctctgctctatccacatgagacagaccaatgtctgcaatctagtgccatacctttccaggttttttatgtccaacaaaaaaagagagcatctctttctagtagctcccacataattaagggtatagcccctctcctgaaccaatcagtcaatcacagtggtcccatctgaccatggggatgttccccaaaggaaatcagggtgttatttttcaaaaggaagaagaaataaatgctggaccttcataacaaccaattgcccactaaaagtgcagtcatatttcttgatgaaatagaacctctccttgtatactgggctccatgacacattgatcatggttagctagaagattctgaagtcttattatccactttgccagttacatttatttgtagctcaaggggactgttaagggaaaggggagcagtgctaaaaacaaatcccattccaatattattaaaaaaaccattgctctgcccttcctttattcacaacttagttcctcatcctcatcttccccagctcctccttttcagcaatttcctctgtaggtgcccctaccactaactcccacagattcccccatctcctttgaagaaaaaagctagatgctcccactccctttatttcttccacagtaaccagcttaactagcacacggctttgtacatggtacacagttaagtaatatttgtgaaataaatacggaacacttaagggaaataaaaagcaatctatcctcatcaagaatgagctgagaatccctgagatagcctatttagcagcttagcctgaattctgttttagtttctgtttctggaaactcttcttattttaagaaagaatgattcttataattatttcatatttgttgatattatccagtcttagccagttatcaaaatggtcttgagaattaggaggggaaagcataatgttataaacatttcagcatattgtgcaagtaaagtcctggtagtctgggtaattctagaactcga

SEQ ID NO: 3256 - DNA, 577 bp, Homo sapiens
ggcacgaggaatgaagaagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattggtaagatgatcatttcaacaaccagcaggctgtgagctactgcagaaagaggagattctggttgaacatgaaggaaaataacagctaactaacttctagatctgaaaaattaaatgtagcgaagtctagtgtgtttggatgctgcttacaaaagcagtgttacaaataaattagaaaaaaaaaaaaaaaaaaaaa

SEQ ID NO: 3257 - DNA, 760 bp, Homo sapiens
agccaaccccacacagatgccagaacacagaactgagctgcaggtgttcattggggtctctgtagtgatgaacagagccaggccaggaacgcggggagccccaaggaaggcaggagggccaatatctgatctgcaggggtcctcagatcagaaggctgcttctatgcaatcgttgctctgaaggatcttcttaataacaactgaatgagcaaatctttctgtcacggagacattggcaaagcattgctggacattgaggaaggactcctctgtcaggggactggggttgtaacgagcaagctcctccttcagraggtcttgggacacatcaaacacaacattcgcaagcagtttatcgatatccaggcaggcatcccccagctggacgctgcagatcmgagccagcagaagagcmcaggtggcgratgtcaccctcatgacagcggagtctggycccagcaggcacaggcagggaatttggcgatgggtgagctttatgtatatctgaacaaggcacatgcctcttcgtgtgtgtgtgtgtgtgtgtgtgtgtgtgtgtgtgtgtgttccaggctggagggcagggcagtggtgttaatatggttcactgcagccttgacctcctgggctcaagcaatcctcctgccacagcctcccaagtagctgggaccacagatgcatgaccagcctttttttttttttttttttccttccatagagacaggtccttctatgttgcccaggctggtcttgaagtccc

SEQ ID NO: 3258 - DNA, 1033 bp, Homo sapiens
ggcacgagctcaagatggatgcagagtactctgggaatgagttccccaggtcagaaggagaaagagaccaacatcagagacctggaaaggaaaggaagagtggggaggcaggacggggcacaggtgagctgggacaagatgggagactgctgtcctccaccctctccctcagtagtaacaggtccttgggccagcgccagaactctccgctgccctttcaatggagaatcacacacagcttccgctggatggcccaggtgttggcctctgagctcagcctggttgcctttatcctactattggtcatggccttctccaagaaatggctggacctctctaggagcctcttctaccagcgctggcccgtggatgtcagcaacagaatccacacatcagcccacgttatgtccatggggctcctgcacttttgcaaatccaggagctgttctgacttagagaatgggaaagtcaccttcatcttctccaccctcatgctattccccattaacatctggatcttcgagttggaaaggaatgtatccatccccataggctggagctatttcattggttggctggtgcttatcctatacttcacctgcgcgatcctttgctacttcaaccataaaagtttctggagtctgattctgagccaccccagtggtgccgtgtccygcagcagcagtttcggctcagtagaagaatctccaagggcacagacgatcacagacacccccatcacccaggagggagtcctggatcctgagcagaaggatacacatgtgtaatcttttctgaactcctggcaccaagttctgtccattcatctgaccccatctcctcatcctcccccagcccttgaataggttggtcctcatcattgcaaggaatgagaaagggaggattttgcactcctctgctttctccctgccttgattgagcttgagtgatgtggaataaattgtccgtctcttctttctcaaaaaaaaaaaaaaaaaaaaaaaaaaaaaaaaaaaaaaaaaaaaaaaaaaaa

SEQ ID NO: 3259 - DNA, 1251 bp, Homo sapiens
  misc_feature (1250)..(1250): n equals a,t,g, or c
ggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcctctggggctctgtggtgtaggctatcttaccatggctttggctgccctgccccaaagccattggcttggatctgagggtctgagttggcagcaaggacccccagctctcactgggctctgtgggctccccctgggctctgtgggctccccctgctccacaggtagactgktgtgggctctttttgsctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatgaaaaaaaaaaaaaaaaaaaaaaaaaaaaaaaaaaaaaaaaaaaaaaaaaaaaaant

SEQ ID NO: 3260 - DNA, 1214 bp, Homo sapiens
gcctagcagcacacagacagcgaagcgggtgaccatggggtggccacggccgggccgagccctcgtggcagtcaaagccttgctggtcttgtcgctgctccaggtgcccgcgcaggcagtggtacgggccgtgctggaagacaactcgagctcggtggactttgcggatctgccggcgctgttcggcgtccccctggcccccgagggcatacggggctacctgatggaggtcaagccagccaacgcgtgccatcccatcgaggccccgcgactgggcaaccgctctctgggcgccatcgtgctgatccgccgctacgactgcaccttcgacctcaaggtgctgaacgcccagcgcgccggcttcgaggcggccatcgtgcacaacgtccactccgacgacctcgtgagcatgacccacgtctacgaggacttgaggggccagatcgccatcccctcagtgttcgtgagcgaggccgcctcgcaggacctgcgggtcatcctgggctgcaacaagtcggcccacgcgctgctcctgcccgacgacccaccgtgccacgacctgggctgtcaccccgtgctgaccgtgtcctgggtgctgggctgtaccctggccctggtcgtatcagccttctttgtcctgaaccacctgtggctctgggcccaggcctgctgcagccacagacggccggtgaagacgtctacctgccagaaggcccaggtccgcaccttcacgtggcacaacgacctgtgtgccatctgcctggatgagtatgaggagggcgaccaactcaagatcctgccctgctcccacacctaccactgcaaatgcattgacccctggttctcccaagccccccggcgctcctgccccgtgtgcaaacagtcggtggccgccacagaagacagctttgactccaccacctacagcttcagggacgaggacccctccctaccgggccaccggccccccatctgggccattcaagtccagctacgctcccggaggctggagctgctgggccgcgccagtccccactgccactgcagcaccacgtccctggaggcagagtataccactgtctcctcagcccctcctgaggcccctggtcagtaaagatctagggcagggaggggggtgcaatgaggaatgtttctggtctgaaaagaataaagtgggtttgaaagcggaaaaaaaaaaaaaaaaaaaaactcga

SEQ ID NO: 3261 - DNA, 1197 bp, Homo sapiens
  misc_feature (25)..(25): n equals a,t,g, or c
  misc_feature (36)..(36): n equals a,t,g, or c
  misc_feature (92)..(92): n equals a,t,g, or c
  misc_feature (1192)..(1192): n equals a,t,g, or c
ttaatccccgtggccctgaaattcnacgcataatgntgcaagaacagttgtcgaaacttggctggggaagaaaatgggcagatttcctgcancctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacmtgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccrtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttcctggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaatgaaaaaaaaaaaaaaaaacccgaggggggncccgg

SEQ ID NO: 3262 - DNA, 1391 bp, Homo sapiens
ggtaaataccaaggtaattaaatttttaagttctgagtattagaggtaatggttactgtagctcctaaaatgcacatcacatctctggtaggtgctggaaccctcatggtactgctgcttttaattttgcttttggaatgtttctttgtagctgaagctttagtgatgagaagttagaaatactctcattgacctttagtgttttgtcctgttgatatatatcaagttcgcttagtttgacattgtttgaacttatttccctaagcaaaaaacagccagaaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggtaaggacaagggaaagaaaactgctcaaggggacctttgtgggggaagtggatagcaagtgctgggtgactggaatgtctgagccagctgacagcccacctgtgggatagagatgcatgatgctgactggctggaatcgcaacctttaatgttctagaatttttcacgtagggtcctcacaataacctgggtcctggcagcagcttgtcttccactcctttctctcttagattataagaacattgtagcagtgcagaatacgtctatgctaactgattccagttttctgtaattctagtccctttttcatatttatggttgcatacattgttgtaatggtgatgtactatttttggcttttttcacttataagtacattttacagcataagcatgtggtgtttttaattgcaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttcaaaaaaaaaaaaaaaaaaactcga

SEQ ID NO: 3263 - DNA, 1517 bp, Homo sapiens
  misc_feature (1145)..(1145): n equals a,t,g, or c
aggagaaactctaaaaactgcagatattatttcatgctatatgttccatcctctgatgagaatgtgaggaaagaaaattgtatcctgcatggctgaaaatggtcccctacaaaaatatcatgttggacaactaatctgagatagtggtatctctggaaagcagtttagcactggtgagtttggactttcatggcaggctgccttggttcatatcttttggtaatgatacttatcctctgtraggcccatttctttatttgtggaaatgaagacaatagagtgcttagatataatttagaacaatgtccgtcacatagtaaacacgtaataaacggtagctcttattgttattattattactattattaccttgaagacaggggctctgtcttgttcatcattccatctccagctcttagcacagtccctggcacaattcaaacatgtatttggatgaatgacaaatagctactgaatatttgccctgttccaagcattgttagaggtacatgggacagggcagtgaacaaaacagacaaaacctcctgctgtctcagagttcacactctaatggggagacccaggcaatgaggaaataattaaaatatacaatgtgtcttatggcaataaatgacaaagaaaaataaagcagaggtgagaaacagtggcagtgttttggtgatcatttgctttgcaacaagccactccccaaagttagtggcctaaaacaatttaatcacagttcatgttctggctacaacaatacacatccctctcatgtgcaaaatacactcactcctccctcagagcctcgtaccattaagggttcaggttcaaagcttaagatcttatcctctgaagtaggtttagggacaaacaagtcttctcaggtacttcttctggggacacagagacttgtgaactaaaagacaagttacctaccttccaacacaactgacatgcaatggggatataggaaaagataatttcaataggcgcttctgtgcaaaagcgggggaaatgagagtcactcagcagtcacggttcatattaatctaaaatctagccaggcatatatcccaagtcttcctgatgtgaggacaagaattatttcttgattagggctcacttwwtctctttgaggntggttcgcctcagcttttggatttgtcctctgaatcatccttccttgtctataaaatgcatgtatatactcatacatacatagagagaaagagagagagagagagagagagactctgtcacgcaggctggagtgcaatggtgtgatctcagctcactgcaacctacaactcctgggttcaagcaattctcctgtctcagcctcccgagcacctgtagtccctgctactcaggaggctgaggcaggagaattgcttgaatccgagaggcagaggttgtcagtgagcagagattacaccactgcactccagcttgggtgacagagcaaggcttcatctcaaaaaaagacaaaaaaaaaaaaaaaaaactcgtag

SEQ ID NO: 3264 - DNA, 278 bp, Homo sapiens
  misc_feature (1)..(1): n equals a,t,g, or c
  misc_feature (165)..(165): n equals a,t,g, or c
  misc_feature (193)..(193): n equals a,t,g, or c
  misc_feature (212)..(212): n equals a,t,g, or c
nctcaccccagcagagattgagggggaaccgtgatgaaatttttaagtattctgcttgatgataataattttcctcttatgttaatgtcggctccgtttgggtgtttagcttttgaaaggagtatgaaaatgcggaatggggctttggggcttgaggaggtgtgnatctctagtgtttaaaaaatttaattgncacaaatagaaatgaattncacccacattattggaaccccactaaagcatatcctttttgtccatattcctttcctgctgccctc

SEQ ID NO: 3265 - DNA, 2597 bp, Homo sapiens
ggcacgaggttacacctcaccccctactttcgctgactccagaccccagaggctgagggacagtagatatgctgcctgccattgcctctttccttgtgcatgtctgagtggtgccagcctgatcagattctgttgcagttccccgtgcttgccacaatgtcggtcgcgtttcttatccaacgctgtttctgcttctggtggtttgtgctaaatgcattttcaatcccaagtggtacagagaagaaaaggattgtctttaaaaagtggctttgaatgtgtcgaaagcaaggttgcctgctgtgtgtttttgacaattgcctccccagaggagcctttgaaaacctcacttttcaagacgcttcaactcctattagaaagtgacttaaataaaattgctcttctgaccatcgcggctctggatgccaggctagtgattatttgtctaatctgagtctccagggctagaacttcacaccgtgtcttttcactaccctcccagaggaggtgagaggaggtgaatagacacttgtcagattcttctgcctggtgtcactgtggggggatgcacacacactggagtataggcttgctaaagagagactgcattgctatttcaactagacacgtttacttttcccgcaaatgattactgagcacctatggtgtgcccggtaccatgttagggcaagagatctacctcatccttgcattgtaaacctgtagcatccgtggcaatgttttacaccactgccctcccagggttcctgcaagctgactccttttattttccttgtgcatgctgatgtgttcaaggtatttcagtgggctactgtgagactatctccccatcaggatctctcaaccttggcactaggaacatgttgggaaaagtaggtctctgttaagggaggaagaggggctttcctgtgcgtgataggatgcttggcagcatccctgtccagtagcaccacatctacctcagttgtgacaaccaaaaatgtctgcagacattgtcaaatgtctcctccctattttacatttaccaaagtgctctttatgtcctttacagttaaggaaacttaggaccaggaagaaacttgctcaagtcaaacagtgagttggcggtagagctttagctacaatttaagtcttgtcttcccaacccagtgtccatcttatggatccattcagtggtttgctcctaaatgcttaataaccaattatctgggataaacgaaagccaaacaaacttgctgggagcgtgggacaatttccatggtgtaaatacttccaccatggctggtttcaagctacttccatggcgtcactgaatgtgaagttgggaagggatctgtacagttggatctggtgagctggtgccagccagctcagaatgcccccaagtccatgtgtgctgctgatcacatattagtcttgctctcctctggaccttgttctgccaccccccagacacatgcccttatcactgtgatgtgctgtggggaaagcagtcacctggtaagagtttttgataacttctctggataaacataaagcagttagagtggagttatccccctcttctgttaaatgaaagtttcttttcacagtctttccattgaaggaattagaaaagtcatgggatacctctggtcttagagcagaaatgaagttccccagaagggggtcctggacagaatggtctcttgggcagggactagatgctgttacttaccatcagatgtgtctactgtaagatgcttgggaggcatcaaagtggtgacagtggggggctgttggattttaccattctggaatataagagaaggggtgtggctggtgttttagtccagatagcagctgtgaccactgggagcctcattttccacacctgcaaaaggagaaatagtgatccccttcctagtgttggtgtaaagagtagatgaacctctgcctgagtctcagatgcctgctgcccacttggttgcttagtggatcggctggctgtcaacagtgtaagcttatcaagcctaaatacttagttggtcttgactttttcacctcgaccatgactcagtgtcatgtgctcctagtcattctgtctgtggtccaacgttagcctgggaagcacctgggactgagggaagaaccctcagctagttattcagcgatccaggttctcctcctgcctttgatatcacctcattatataaccttgggaaacactttggtgtgactggaatgtggatactcccaggggaagggtaggagcatggtagggcatttggactttatcatgaaggtggtaggaaatacttgaagggttttaagcagggatgacacatcatcaaatgtgtgttttgaaaacttttttctgcagaggacagggccacagcccaagcaggatcaaaccagttaggagattgatgtaacagtcccgtcagaaagtgatgaggtagctgggtgcggtggctcatgcctgtaatcccagtcaccgtgggaggctgagactggcagatagtttgagaccagcccttggcaacatggtgaaaccccttctctacagaaaaaaaaaaaaaaaaaaaaaaaaaaaaaaa

SEQ ID NO: 3266 - DNA, 2541 bp, Homo sapiens
aattcggcacgaggttcctggccaacctgctgctggaggaggataacaagttttgtgcagattgccagtctaaagggccgcgatgggcctcttggaacattggtgtgttcatctgcattcgatgtgctsgaatccacaggaatctgggggtgcacatatccagggtaaagtcagttaacctcgaccagtggactcaagtacagattcagtgcatgcaagwgatgggaaatggaaaggcaaaccgactttatgaagcctatcttcctgagacctttcggcgacctcagatagacccagctgttgaaggatttattcgagacaawtatgagaagaagaaatacatggaccgaagtctgggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttcgggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcytcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggacaaaaaaaaaaaaaaaaaaaaaaaaaaaaaaaaaaaaaaaaaaaaaaaactcga

SEQ ID NO: 3267 - DNA, 1028 bp, Homo sapiens
gcacgacaattgaactgaaccctaaaaatgctacttcaattcaccttatgggtatttggtgctatacatttcccgaaatgccttggtatcaaagaagaattgctaaaatgctgtttgcaactgcctcctagttccacctatgagaaggtagtatgatgtcctttgttaagttagtacggatttcttgaaccacagcgcccattctaccatgtgttccacacattgtggagctctggattcagtgaaggggacttgaggcaatttccttaacgatccaattcaactgtgttatcacaaggcttaacacttattatccttgactggtgagtggttttctttttccccgttaggtgagtggctggtaattctggaatactgtcatctaaaatggctcgtggctaaaatctaccttcattttctgtttgaaatctaaactatattgaagtcataaaatagaacaagaaatacagcatctgttacccagcatgttttagctgtattacacacaataacagaaaagtaaagcagatgcttaagttgataaaagaagaacactcattataacttctattttaaaaagcatatgaaaggttcatattctctcatattttcaaggccttttgcttttcttgttaaaaataagatttgagaggaatttctggttaaactttgggtttactcatcacaagcttttcagagtaagaaaacaggcaatcgaaaaagctgtacttgtattatttacattataacaaggagcctttttttctttctgggaagctatagtgtagaaattgatgtaaaaaatacttagttgtattctttacacacagttgagaaatattattaaaataatgcaccaatattttataatggtattattaaaataatgcccatttgctggacacggtggctcatgcctgtaatgccagcattttggaaggccaaggttggtggatcagttgagcctgggagtttgagaccagcctgggcaacgtggcaaaacccctgcaaaaaaaaaaaaaaaaaaa

SEQ ID NO: 3268 - DNA, 1279 bp, Homo sapiens
ggcacgagtttattttaaaatgtacaataaattattgttgactgtagtaaccctgttttgctatcaaatagtagattttatttattctaactatatttttatatccattaaccatcccccacatccccccaatattttagttttttgaggaactccagtgcatcattaatacccacttttcctccctcctcctctctcaccactccccaagccatttctaattcgtctccaagccttgtgtaattgtttattaatatttatttatttggctgggtgcggtggcttacacctgtagtcccagcactttgggaagccgaggcggctgggtcgcctgaggtcaggagttcaagaccagcctggccaacatggcaaaaccccgtctctgctaaaaatacaaaaattagctgggcgtggtgatgcacacctgtaatcccaaccacctgcgaggctgaagcaggagaatcgcttgaacccaggaagtggaggaggttatatatatatgagacatatatacacacacacacacacacaaatataaaatatgtgttgatatatatatataaacatatatatatgtttatttgtcccctctttcccattctcattgctgctgtccctattaagacctttatcatcatttctttggcctaattagaatagcctctggtcttctagttttcattcttatccattgctagttaccttttattttgtcactaatgtgatcattcaaaattgctagtttggagataatatattcctgtttcaaaaccctccccttgaggtgtacccaacagctcattgagaacgggccacgatgacaatggcggttttgtggaatagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactctgcctaggaaaaccagagacctttgttcacttgtttgtctgttgaccttccctccactgttgtcctgtgaccctgccaagtcccctctgcgagaaacacccaagaatgatcaaaaaaaaaaaaaaaaaa

SEQ ID NO: 3269 - DNA, 1479 bp, Homo sapiens
acgsgaagctcgaaattaaccctcactgaaagggaacaaaagctggagctccaccgcggtggcgggccgctctagaactagtggatcccccgggctgcaggaattcggcacgagcttgtttcatgcccttccaattacctctccagcttttactacttaggttaatttgtgaattctttcttgcccctgccttaaattgtaatctcactgggactgtgattttctttacactcatgatttctttacagctcatgattttctttacactgcagtttgctgatggcttccaaattggtgttgatcttcagctttcagagttgaatattctgtaggtggcttcatatgtcattcattccgtcttctcagtttattcttaaatatgacccaactccagcctttatcccaatttatactacctctgtcctgattcaaggcttcattatctgtcacctaaatgtacttgaagctgtagtgccctgcttcattcttgatctcttcaaatctgcttttttataaggccagcaggatgctttggcaaaaatactgatcttagtgactggtctttttaaaagcagaaattatcagatctctgataagaatccccaagagtaggataccttgaagtctattttgtatacaagttcattccatacctgcagatctggttttaatcagattgagaaacttgcagtctaccagaattaagtttgagcccctctgcctggtgcataaagtcctccatgacctggttttgctttacctgtagttcacatttcccactatggcctaatttgcagcagtattgaagaacacactctcttactgtcctgtccccctacctgctgtatcctttgcatagaataagtgccattctcttccagtctacataacgtaccttcacttttttttgtggcagctgttattgcactttgcaacatttgccaaaacgtttctgactccccagcctgttttatagtaacactcatatggacaccttgaaaatttataaaatattatttcattggatgagaaaatgaatcaattttaataaaaataatttacaccaatgttaacattaaagattgcactagagttcaaaattagtatatttttatgtttaaagaaattttaggccaagtgcagtggcctgagcctgtaatcccagcactttgggagactgaggcaagtggatcacttgaggtcgggaagttcaagaccagcctggctaatatggcaaaaccccatctctactaaaaatgcaaaaattaacaatgcttgatggcaatgcctgtaatcgcagctatttgggaggcagaggcaggagagtcacttgaacttgggagttgccgtgagctgagatagcgccagtgcactccagcctgagtaactgagactcctatctcaaaaaaaaaaaaaaaaaaaaaactcgagggggggcccgggtacccaattcgccctcatcagtgcagtcgtattaca

SEQ ID NO: 3270 - DNA, 1106 bp, Homo sapiens
  misc_feature (318)..(318): n equals a,t,g, or c
  misc_feature (509)..(509): n equals a,t,g, or c
  misc_feature (523)..(523): n equals a,t,g, or c
gaattcggcacgagatgctctcctgagtcctctgctagttaagctctctgaaaagaaggtggcagacccggtttgctgatcgccccagggatcaggaggtaagcaccatagaggagctgggttagagacgagagacttaaccgtttctctgctgaaaaagacaactgaggaaaggccagccatgctgtgcacacctctgagaacctgaacctgcaaacatggacatcagctctgaaaggatgggttcatttctcttttattcactttagccatgtcctctggtgtctctgagctggtgttccttaaagcttcggcttncctttggggtttgtctatcagcctatttgtaaggctgacttttatgccaatmgcaaatacaagcattttttaagttaacagatattatgaagtaaaatgcaagtttttcatttataaggcaacataacttcagagaaaaaactgagtcaatcatataaaatgtgattaaaatgtgattgttattatataanagggttataggaanattagcttcttatggacaagtagaaaagtaggaatcatccaagctgattgtcacagtaaatattcaacaaaggtagtgtccttccttgctttcatcagtaggatgggggcatttggatggctttatcattgcaaatatttttaatgtattccttattttgaaaatggtcctgataatagttttaattttcactcatgaactctacatgtataagtagagtttctccagcgcttaccaacatataggaaaaaacattataaggccattaacagtgatagtttagaatttattaacattgactctactgatgggggtattcaagcttccctaaaattcacaatcagttattttcagctcataaacatcttttcctgttctttggcttatttcttccactttatatgttgctgctctggaagtcattaattgctaataatgtcaaacatcttttttatgtttattggatatttgagcaaattgctcattcacatcttttgcacacttttcaaatagactgttgttttcttattgatacatggttctccatgtattccaaaagcaaaaaaaaaaaaaaaaaactcga

SEQ ID NO: 3271 - DNA, 1242 bp, Homo sapiens
ggcacgagctggcattggcagcttcaggcctaactttcctggtcagggccccttaaggtggcccgggcacattggtttcatttcgatgagactttgtcagaggcctggtctggtcctggccctaccgccccagctgtccttcagcacagctcggggtggggactccaggatgctgggtctgccccttgggaggggcactctggaaggtcagggtgatccacaactgtgagctgaggttggatgcagctgggagcttgggacagagagagcccagggctcccctgctgtggggcacctgcccagcggggacatgagatgacagagacctccccggcgggggtactcaggtgctacgaacatggcagctcttgtttccggctgagccatggccagagcagggctcagtctgcccctgaacttgctgaatggaccgacgagctgagcctgaaagcccagaagagcctcggtccagaagacggagactcggcccggtgtccagcgcagcccagggcttcctggggggcagcaggagtgcctgggggtcaccgccttcaggacaatggcctcagtggctctttctttctgccctgaactggcacctgcacctcctctgcttcctagagggtgacctgggccgagccgcccagtccttcttcccctgaggccagaggggacgccccgcggccacatcacacaggatcctcagcagccatagtctcgcttcagggtgtccagtgtttcgaggaggagaggggacaggggccaggtccactcccttggccctcctcttggaccccaaggccaggccggatccttttatcccgtggggagcccctgcctcggccatcgggatgaggtccctcaagtccctgcacaagcaggtcagagacccacccacatgccgttcctggctacgccacgcgccatcccccggggctgtggacgcacccagcccccgacagacaggcgccctgagagctccgaaggcgcgatccccatccccaccagtggagaagccagaaccgcgattgttgcatctgggaaaacccagctggagccgaacggcccgtgcccccactgtaattgtgctgaaaatgtttctcaaatgacccaaattggctcttattttttctaatggccctttcaaagtattcatgaaattgatgctgtgtcataaaacaaaaataaaagatttcacagcaaaaaaaaaaaaaaaaaaaaaaaaaaaaaaaaaaaaaaaaa

SEQ ID NO: 3272 - DNA, 2432 bp, Homo sapiens
atgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaggaatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaaaaaaaaaaaaaaaaaaaaaaaaaaaaaaaaaaaaa

SEQ ID NO: 3273 - DNA, 1965 bp, Homo sapiens
  misc_feature (51)..(51): n equals a,t,g, or c
  misc_feature (476)..(476): n equals a,t,g, or c
  misc_feature (1136)..(1136): n equals a,t,g, or c
aagaaagggtattaaaattctagatcacatatggacccgggaaggtttttnaccctctgttagtgacatcgagtctcccactagacaaaataggtggaaaaatctctcgagggctcacattgttttgtcatcttcaggaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggnccgcttgctgcctgtctgctttccttggtggytttgctgggtgctgggcctgccctctccggccgcttgctgcctgtctgctttccttggtggctttgctgggtgctgggcctgccttctctggctgcttgctgcctgtctgctttccttggtggctttggcttctgcactccttggcgtcasctctcaggtcctccattcacacgaggtcctcctcgctctggccgctcttgctgctcctgtctgaagawatcagactgatttcctcttaagactcctagggatgtggtgaagagctgggactcaagtgcagtccacggtgtgaaacatgagggargtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcangcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaagctgtctttgttcaggctgctataacaaaaatataatagcctgggtggcttaaac

SEQ ID NO: 3274 - DNA, 1709 bp, Homo sapiens
gtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgaaaaaaaa

SEQ ID NO: 3275 - DNA, 629 bp, Homo sapiens
  misc_feature (33)..(33): n equals a,t,g, or c
  misc_feature (44)..(44): n equals a,t,g, or c
  misc_feature (70)..(70): n equals a,t,g, or c
tcactaaagggaaccaaaagctggagctccacncgttggcggcngctctagaactagtggatcccccggnctccaggaattcggcacgagtttactattcatgaagtggaaatggatcatcatgaaggtcttcatccctgtcttcacattgagtaggctatcttgctgtctcaggggtggcagaggcggaagaggtggaggaagtggatggggaggcggaagaggtggaggaagtggatgggaaggcgggagaggcaggcacacttggtgtaacttttgttgaaaaaatatctttgtataagtggacccacgcagttcaaacgtgttgttcaagggtcaactgtggtcatattgtcggggttctttagccattaggtctcagaaattagcctgaatttagccagacatagtagcacacgcctatagttccagctgcttgagaggctgaggcgggaagatcacttgaacccagactgcagtgggctatgatggtgtcactgcactccagcctgggtaacacagtgagactccatatcaaaaaaaagaaaaaaaaaaaaaaaaaactcgagggggggcccggtacccaattcgccctatagtgatcgtattacaattcactgggccgtcgt

SEQ ID NO: 3276 - DNA, 1321 bp, Homo sapiens
ccggatcaccaggtcaggagatcgagaccatcctagctaacacagtgaaatcctgtctctactaaaaatacaaaacttatccaggcatggtggtgcatgcctgtaatcccagctactcaggaggctgaggcaggagaatagcttgaacctgggaggtggagattgcaatgagatgacatcgccccactgcactccagcctggcgacagagcaagactccatctcaaaaaaaagaaaaagtcatttggaagagatatgtgtagtgttgttctgttaaaagactgtccactgttttctttttcagtaattaatggtcacacactgtgtttacggctgttgctagaaattgcagacaacccggaggcggtcgatgtgaaagatgccaaaggacaaacaccactgatgcttgcagtagcatatggacatattgacgctgtttcattgttacttgaaaaggaagccaacgtagacactgttgacatcctaggatgcacagctttacacagaggggtatgtacatctttctcagctctagtcaagcaatttttttaatgagcttgttttcttttttagcaaacaattacaaagggcctactttgattggatttttagcaaaaaatgtttagcaaaaattgtttcctaatacaaccaattaaccttattcagtccaaaagaaattacaaaatccttggcaaaggcaaaataatggaaggttttgctcttaagatttcatgttagattgtgataatagatgcatgaacacctactgctggtgaaattggttctgctttctgactacaaaatacaagtatatcatagaaaatttgcagaatatttttttttaaagcccagagaagaaaatcacaatcaccagtaatcatacctcctggagataaccactatttgatgtatattatctccaatcttttttctatatatagatttgttttagattttaaaaagagaatactgaagatatcatttggattctgcttttttctcttagtatatcaaggatcttttttcatttcatttttttctgcatcatgatttttaatgcctcattgtgttcaagtgtcatagtttatttcaatgattacctggttttcagtagttatgcaatttctaattgtttgtccttacaaataatgccaaaatatgtatcctgtgggcaattatttgcacacatctgttgaagtgtttggtttttttttttttaatctcactcttatcacccaggttgcagtgagccgagatcacaccactgcattccagcctgggtgacacagcgagactccatctcaaaaaaaaaaaaaaaaaaa

SEQ ID NO: 3277 - DNA, 3105 bp, Homo sapiens
gcaatgggacttatcgctgctgatgttaaccttgatctcttggttcaggtggtgcctgccagctgtctccactgtggagttactattttyccttttccccatttwattcatcagaagccagtcactaagcgaggtcaaactccaggacaggggaattaagtgccaccttctggagagggagcattcacatttattacttgggatccttctgtaaggaagagctgtttctcctctaaaaaactctttaatccttttaagcctcaatttcttaattgtgaaatggggctaatacctgtatccaaccaagggagtagttagaaggtaacatgataggtggaaagcacttaacataggcaaaatgttatkatcaggaatgatcgagagacccatccaactatctgaaggagtcacttaactctactgtactgcagcgctgtaaagtctgcatctttcactgggggtaaaggcccccagtccctgagacgggccagtttggagacaggctggttttttctctgttctcctgagagcccttcagatgagaagggaggtctggagacagaatgccaaaagcccattaaaggcacggccttgcatttcagagagggagcaggtctagagaagaaccagaggagctcagctgagatatggtgtatggattggattttggtagaagatgggaagaaccaaacacctgagaaaccactttgaagatcggggtcagagtaaggcctaacacatagttggctcccagtaattattggttgattgaacagctcaaagagcaactcgaccaagaacactggactgggagtccagttacttggatcttgcattcctgatttatttttattttatatgtattttttctatttttttgagacgaagtytcactcactctgtcgcccaggctggactacaatggcacgatctcggctcactgcaaactctgcctcccaggttcaagcgattctcctgcctcagcctctcgagtagctaggattacaggcatgcaccaccacgctggctaatttttgtattttwagtagagacggggttttgccatgttggccatgctggtgtccacctcctgacctcagttgatcttcctgcctcagccttccaaaatgttgggattacaggcgtgagccaccgtgcctggccgtgatttattttttttgtgtatgtttgtttttgtcaacttgctgtgtgaccttaagcaagttacttaacttctctgggcttcactttccatggatgaacattgtaaagaggctggagagagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgytttcattacaaataagaccaccgagtgggctcctggcgtgggggcgggagcagccgcgcgcagtcttcagaggcagccccccaggctgtctctggagggtgtgtctctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcagaggtggggtgcgggcgaggggacgatgcattatttttaatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaaggtcaggagcggcggtgtggatgtsccttggmtgcaggccccgccgcgcactcccttcagtccttcccttctctagggaccaggtagcatcagtgcctggatctcggccttgtgtgccctgctccctgccccacctactaagaaccaagtctggttcaccggctcccaagagctggaacccattctcagctagctgggggcccaggccaccccttccctccagacctgtgtgccttctgccctggctccagggccccccacaccgtgaccagggcgggatccctatggggctggccagtcggcaccgtgccaggcccacagtgccctgggcgtccatggaagtcgttctgtgtctttaaaatcagaaggaagacattaacctttaggctgaagaaaatgttttagtacacagcaataacttatttgtctttatccaacagccataaaatataactttaaatattctattgatagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaaaaaaaaaaaaaaaaaactcgtagggggggcccgtacccaatcgcctgtgatgatggtatac

SEQ ID NO: 3278 - DNA, 1573 bp, Homo sapiens
agctcctgcctcggcttcccaaagtgctgggattacaggcaagagccacggcacccggcctaggttagatttagagttttcagagttggcttaggcggtagaggctggcctttgaatggaaccctgtctcgctgtcgctctcagcgtttatatttggctcagagccacatctgccaaacttctgcccgatttgaatgaaagtgctgaaattataggcccctcggctgctgaaaaaaagtgagaacatcatgtaaaccgtaatttactgggattgccaactacaagctgtaattaagcccttattgtgttaaagctttggaaaaatccaagccaataatgagatatttatagggcattagctacaatctgaataaagggaaaatgtggccctgcgtctgaagcaggactgcaaagagaggaaagacgcctgcttccgggtgcgttttgggtttctgtgaatattggtaactaggtccctgctgggtggtgggaaattttcccctgtggcgtcacccgtagcttgaaccgggagctggatgactgtttcagtttcatctgctgctggacatttatgatgttaagagccagtgtttatggagaatcaccgtgtgccacatgtgcaagatctgaccagtgtcttctctgcccaggggtggcagctgctgctcttagcatccctgctttataggtagagaaactgaggccagagagggagactggcctgaagtcacacagggaggaggacagaggagttggagcttgaactggatgtgggccctctagagccacacatatggcggctttgggtgggaaggtgtgggcctgactcttgagagcagggctgaatggtgggcaccatggcgtttgtatctgaggactgggccaagattacagagggagtgagcaacgcgtggctttggatatgcatcgaggttgtcagctctgtgtccagcctgcgtgtggtaagcagcaaccactctacaccagttgctgggcacccagcagggactgggacagacaggacaggtgaacagttaaatgagcaagaacattctggggcaggcacaggggctcacacctgtaatctcagcactttgagaggccgaggcgggcagatcacttgaagccaggtgttcgagaccagcctggccagcatggcgagccccgtctctgccaaaaatacaaaaattagctgagcatggtggtacttgtctgtcgtcccagctacttagcaggctaaggtgggaggatctcctgagcccaggagttcgaggttgcattgagctgtgattgcaccactgcgctccagcctgggtgacagcaagacccggtctcaaaaaaaaaaaaaggctgtatgcggtggttcacgcctgtaatcccagcactttgggaggctgaggtgggagttcgagaccagcctggccagcatggcgaaaccccatctctactaaaaatataggcaggagaatggcgtgaacccgggaggcggagcttgcagtgagccgagatcgcgccactgcactccagcctgggcgacagagcgagactccgtctcaaaaaaaaaaaaaaaaaa

SEQ ID NO: 3279 - DNA, 2233 bp, Homo sapiens
ggcacgagcttgatttgatatggtaagcagtaatatttaaaatggtgatggtattcttcttaacattttctggctcccacggatgtgttccgacatctcagccctggaaggatgctgaagaccaggttgggtgtgtccatgccgtagcttgggtgaactcagctctttacacagtcctctgcccctttctgggaaagcccaaatgttcattctcatttgataggaacgagagtgaggatttgaataagcaggaggttaagtgcagggcagtgcctgtctctgtgtcgagctcaatgttgtaattgtgctgtgtaaaaggcctgtgtggtgaacaagggtgagctcactccagggaggagaaggactgttagaagacttttgtggcacctgacagccctgtggggtcagcttattctctcgtaccctgaacaacttggtcctaaggcctagtagagatttgaaggaagaaagcaacccagtcctcaactctgctttttttagaatgaagaacagactagcaaaatagcattgccatacatctcaaggcagagagatgcgacagggattggaagccaggtaattggtcaggaaacattctggagacaaatttggggaccaagactcaaggattgggaaggacaaggaaataggatctaggtggtctaccgtctaggcctgttggttctcccttctccatgatagttagtggggaaatcccacgtaaggaaagcacgggtagtaagaaacttgggaacaaataacacctagaaactgaggcagcaagatgcaccttagtctaggaagccttcttgaaagaggggagtctctggtaagaatttgaaagaaaagaaatatggcttgcttagcaagaatataagaaaggctttgaggaagaaaagatagccagtgagtgccaagcatctggttgggcttgagggtgagcacaaacaggaagcaacccggccagcccctctgtgtttctgccacagtcaaacagtgctcaaggaatatgaatacggctgtcctgattgtgaaagaagagaggggcccgaggcaaaggaagctggcaggcagctcctgctgatcctccagatgctagttgataaaggcccaatttcaaatgaaggttttgaaagcaaaaggacagtaggaacccggaggcagggaatgaatcacaggacttgggagcgggtgtggggtgaacctgaaattgagacaggattaaaaacgacctgtctgagatgggacaggggctggcttgtttcacggacttcaatgcttctggcagcaatggggaaattgggcaggctggctatcataggaggctgggcacagaccctgagcccaggggatggtacattgagtagccagtggccccgggtgaaagttctgcagccaaaaacaactgggggatgaggaaaaaaggaaaaattcaattctagtctctcccattaagcccccttcccaatttgaagactggcccaagaggccttcgggaatacccctcctgtcttccacccttctcatcacttccctgtcccttctctgtcctttcccccaactctccccctcaagcccagtctcgttgtcaccaaggcttctaggtgattagagaatcccacctcatctccacctggaaccctccctccacttctgcactcctagggataaaccgttgcacacccctgccccacctggaagggcctacagggtctccagtgaaaaacctgtgaactgttgaacctcctgtttggtggcatattattttgatttttggtgactttttcttggaataagtcaacaaatattaaccaagtgcctaccacatgccaagcgctgctctaggtatacagtggtgagcaaagttgggttgagtttttcaatagaaaatccatgtttgggtaatttaagcttaaaatatcatgcaaacaggctggatgcattggctcacacctgtggtcctagtactttgggaggccgaggcagacagatcacttgaggtcaggagttcaagactagcctggccaacatggcgaaacactgtctctactaaaaaaatacaaaaattagccggacgtggtggcgggcgcctgtaatcccagctacccgggaggctgagggatgagaatcgcttgaacccaggagtcggaggttgcagtgagccgagatcccgccactgcactccagtatgggcagcagaatgagactccatctcaaaaaaaaaaaaaaaaaa

SEQ ID NO: 3280 - DNA, 938 bp, Homo sapiens
  misc_feature (479)..(479): n equals a,t,g, or c
ggcacgagtggaggttcagggtcagggtccaggggcgaaggtggacgctggagaagggcagatggacagggtcaggttcagatcttggctcttgtatccttgctgtgtggctctgggccaagaacttggcctctctgcgcctcagtggctcattacagaaaatgggatgccagcacttgccttagtgggttgttttgagccaactgcaggctcagggagtagctggcatgatgtgttcctaccctgaagggcagaaaaaggggaaggaggccaccagatcccacaggtgggtccccaggtccctccccgggatgggcagcakcctggctgctccccacagcaacccctggctggccccattggcgctgctggaaatcccccamccagttctttgtgaatggaaaaggaaactgattgcgctagaagaggtctccgaatgccggccgggggtggggggcggggggggsttcctctcccantgcaggaggggccacctcagcttcctttctggggccccataccccctttttcctatctcccctctgasttgaggaggaggctgtggcccccgcccactgtttggcctctggaaccactgggtgacagtgtacatcggggcgattaagggccacctggcctctggacctccctcgctgtggctgctgcctgggaccccccaccccatgcctgactcgaaccccaacctcagctctacacacaggggcaccactgtaggaggagagagaaacctctctctagggaaccacctggaagggggccctgccctgtcttcatctgggtaccccatgtaatctaggaaactgtctttaacttgccgagggcctccatgtctgagttcctaatgttttttattttgctttttcaattaataaagctcatggcagaaactatttaaaaaaaaaaaaaaaaaactcgta

SEQ ID NO: 3281 - DNA, 719 bp, Homo sapiens
ggcacgagcctttcttggccttcatcttctcttcttacactgctcctgggtgctatctgctttttgagttttagtcatgacctgtttccctacgcgcttggggctcagctgccccaaacctgccttcctccttgtacccctggccctggcccagtgtgtggtgccagctgggttcttggggaagtgctgtctgctggggagactgatgtgtgcagagtgtattgggacgtactcatgggatcagccccgtagaagggaagagatggaggcgagactggacagtgggagaagctgggcctcagtgctatatggacacaggcctcagctgcacggggagccctgcactgccgtggcctgcagacgtgtcccatgttgttctgagggggccgggccattctcctccctcactgaccagcagttgaatgcagtctaccctgggtgatgtggttctcttcagcaaggagacaaggcttctgctgacccagcagggcctgtgcagctgggaagccgtcggagagatctctggcgatgggagggccggggcttcctgtccccgtgccaggccctgggtgctcactgctcccaggaaagggtagggtcttgatgaagggctcttgcccgtcaaggacaacttctggggaggcagcactctcccctggggaacgggcctctcctccctgcaggccgtctgggcgactcattagtgccccctgcagtcg

SEQ ID NO: 3282 - DNA, 1618 bp, Homo sapiens
ggcacgaggcaaggacatgaaacacctgtggtttttcctcctgctggtggcagctcccagatgggtcctgtcccaggtagagttgcaggagtcgggcccaggactggtgaagccttcacagaccctgtccctcacctgcagtgtctctggtgtctccatgagtcgtggtgattggtcctggagctgggtccgccaggtcccagggaagggcctggagtggataggacacatcgattacactgggaagaccgactacaaatcgtccctcaagaatcaggtctccatatcacaagacacggctaagaatcagttcttcctgagggtggagtctgtgacggccgcggacacggccgtttatttttgtgcgagactcttcgaaagtagtggttacggtgcctggctcgacccctggggcccgggaatcttggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaagcaaaaaaaaaaaaaaaaaaaaaaaaaaaaaaaaaaaaaaaaaaaaaaaaaaaaaaaaaaaaaaaaaa

SEQ ID NO: 3283 - DNA, 1637 bp, Homo sapiens
ggcacgagcaccactccctgctcttctgcaccccaaatcttctttgttgggaaaagaggtaggagggagctggctgggaggctcctagtctgttgggaagcagtggatggtggctcctctccatctcttcatccctttctcttggctagtgaggacaatagggcaattactgagtcctgtgggcaaggcactgagtcatcggtcgaatcagatgatgcccaggtcctggggatgagtgagtcactcttaatgggcagctcccaagatgaatgttgagagcatcctgcctggctttatgcctgcaagccctccccgtaatctccttccttcttgcaggtgggcaggaagaagcagggtagaaaagttagattcctaatctaactcctacccctcaaccccaagggaccttgttggtcaatagcgaaggaactgggaaggatgttcaaaggctgaggcagggcacagatgtcacatttcatctctgtggaaggtgggctgctcaggccagatggatgagcttgtttgtgtgtgaatgttcctctcaccttcctgatggtgaggggggcgatgtccacttccagatgctgccaagtagacttcctgttttcttcctcttgtcccccccccgcttcctttttatatttacaaagctctctggttatgtacagcagggaaatggtgcctgagagactccttcagatagcagttccttctagtttgagtcaggaggcactgcgtccccagagtccctgcatcctcattcatgaaatgctggcagtcaagggaacagccctggctatctcatgaggttggccttaggatttaagtgagataatgtgtttgacaatggaatcccagcatgagcttgggtttcggcttcattaaaaaattagaatttattgtagaaaatttagaaaatagacagaaaaaataatcctagtaccttctcttactatttgatgtatatcccatatttttttcaaaaaaaagaaataatgataataacatgatagtcatgtatcaatgcattttctacttttgatggttacattattattatgtgagagaaggtcttatttgtggagataacaactacaaaaagtatttgggggggtgatggagcatcaggtactcactcaaatggttgagagcaaaaagttatttgtactgtactttttcttaactttgtgaatattttgaaataaaagtacgtatgccatttggagaaaagaagatagcatagtggtggttttttatgtctggaatatccatgtctgtctattccagtgtctggaatatccatgtctatctatccactggaatatccagtgtctcagttgagggtacttaaagggaaaaacctcccacacttgactttctttgaagagtttacaaagatttgtaatttcagcctgggcaacatggtgagatcttgtctctatatgaaataaaaaaaatttaaaattagctggatgtagtgatatgtgcctgtggtcctagcccttaggaggctgaagccaggaggattgcttgagcacagaagttcaaggctgcagtgagccatgaagtctctcttgtattccagcctgggtgacagagcaagaccctgactcaaaaaaaaaaaaaaaaaaaaaaaa

SEQ ID NO: 3284 - DNA, 1265 bp, Homo sapiens
ggcacgagtttggccgggcgtgatagctcaggcctgtaaatctcagcactttgggaggccgaggtgggcagatcatgaggtcaggagttcaagaccagcttggccaacatagtgaaacaccgtctctactagaaataccaaaaattagccggacctctgatgcctgatgtgcaggggccctggcaccctgctcacccacccatcccttctgctgccctttgcctgctctggccacactgccttgctgctccaaaatatgccaggccccgctgcctcctggtctttgtgctatgtgaccgctctgcctggaatattctactctactctgtaggaagcaaagtttcagggctttgctcaaattgctcccttgtgccgggtgtggtggctcatacctgtaatcccaaagtgccgctgggtttgcaaggctgtgaactaccatgcccggcagagcatttaatattctccaaatgtctttcctcgtgtgctacctgggctcactgctttctggggctctcgtgttgctggtgtctccacccccacccccaccccagctggcctgctccattcctgtcccggtgggctcatgtctgagtgtgcggactgggggatcttggtggcgatggagccaagcccagggaggctggggccaccctcatagtgcaaggccacccagcacctcgcccctataccccacccgccccaccaatgtgccccccgcacccccgagcccaggccccaaggcttgcttctatgggctttgcaccaccctctaggctgctcccgcctgggccatgcagcgcacctgaggggtctgaggtgaccgctcctcagagccgcccggcagcctccctggggcgggcctcagcactgcagccccgtgatccggcctggcgtgggctttgctgctttctctgcccggtggcctgaggagctcgagtgcccgcctgcccccagagccctttcacggtcagggcctgagctctgtgggtgccattaggaggagggtctgcagatctgtgcggttgggggacccctggggcatggaggggaccacgcgtcccttcccgtccgtgccctgccaggctgtcctcacagcagcgtcgtcacaggggaggaaaccagggcagcggcagcggctcctggtaccaagcataccttaaaaatgagcccatggatgttgcagtgagccgagatcacgccactgcactccagcctgggtgacagaagcgaacttcgtctcacaaaaaaaaaaaaaaaaaactcga

SEQ ID NO: 3285 - DNA, 1166 bp, Homo sapiens
  misc_feature (5)..(5): n equals a,t,g, or c
  misc_feature (1158)..(1158): n equals a,t,g, or c
  misc_feature (1163)..(1163): n equals a,t,g, or c
  misc_feature (1165)..(1165): n equals a,t,g, or c
ttaanaaaagttgccgctccaccgcggtggcggccgctctagaactagtggatcccccgggctkywkgtttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagcactttgggaggctgaggtgggcagatcacctaaagtcagaagtttgagactggcctgaccaatatggtgaaaccctgtctctactaaaaatacaaaaattagcctggcgcagtggcgcacacctgtagtcccagctactcgagaggctgaggcaggagaatcactggaacccaggaggcagaggttgcagtaggccgagatcgcaccactgcactccagcctgggcaacagaggaagactccatttcaaaaataaaaaataaaaaatcggcctcctgagtggctgggaccgcgggcgttctccatcatgtccagctatttttgtatttttttgtagagatggagctctcactatgttgcccaggcttgtcttgaactcctggactcaagtgagcctcctgcttcaccctcccaaaaagctgggattacagacataagccacagcaccagctgaacttttttttctgagacggagtcttgctctgttgccaggttggagtgcagtggcaagatctcggctcactgsaacctctgtctcctgggttcaagggganccccngnc

SEQ ID NO: 3286 - DNA, 1566 bp, Homo sapiens
  misc_feature (5)..(5): n equals a,t,g, or c
  misc_feature (12)..(12): n equals a,t,g, or c
  misc_feature (16)..(16): n equals a,t,g, or c
  misc_feature (170)..(170): n equals a,t,g, or c
  misc_feature (184)..(184): n equals a,t,g, or c
  misc_feature (728)..(728): n equals a,t,g, or c
tgctntggccantggntggttggggctcgggttggcgtggtgtgcaggctgcattgctttggccagggaagcaggctgaagcgtgtcccagccctcccgtggctccacgagacttgcttccccgttccccctgtgaacaacctgggccaccagctcggtggtggccaggnccactcaccacctntttcctccccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccrggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcaggntgggtggggttattgttagtaggcgcactcattcccaccacgatctgttccgcgtggttcccgccaaacctccctcggtcgccgtgttctccgcaagcctcctgcagcgcccgcctgccaatgtgaggctggcaccaggctgcagctccccaatcccagcccactttgctgtgtctctggcgggctgtcctccttggtgggagctgtcctgcacactgtaggatgcttaaaggtatccctggcctccacccayccctagccagcagctcccagtcagacaacagccagaaatgtctccagactctgcccagcctccccaggtagccaccctcgagacaygacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaagaaaaaaaaaaaaaaaaaaactcgtag

SEQ ID NO: 3287 - DNA, 1962 bp, Homo sapiens
ggcacgagcacccccagaagttctgattcagtgggtggcgggtgaggcctgggaacttcatgacgagccccctggcaaggctgctgctgccattttggtgccacactttgggtactatggctttgggcactcccaatccaggtgccatggcatggggagcagtgggtgaaccaaatcctggagcctggactgttccattgggtgcattcctggctggcagatagaggaccacccagctgtgcttgatggggtctagaagcattgaaactggtttgccgttatgatgtccatgaggttggagtcctttcttagttaaaaaatctgaagacccaacaacacacagcacccccacgctgaaccctcccgagaatgattgagctcttccaaataaagggcgattttgtagcttttcaagttttaacagtttgataactcccaggctcctgttgagatgctttgtgatgaggttgtgcgttcccctgtatctttcctgtgggtgtttatgtgtacagaacacatgtatctgtatttacgtgactgagcacaggcgatttccccgagtctcaccttggtgtgtgccagtgcatgcgcgtgcgcgcgcgcacacacacacacacacatacctcctctcagagaatgttgatgtggcaattcatgtttgacagctgggttaacccataaatagatcccaaaatataaatttacccagacctcaacctgcttaagcctttaaatagctcactagggcttttagaatgaagttgaaattccttggcctcacccttaagcctttttagaaggagtcatggaggaagtaaagaaatggaaatggagttgcctcgctgggctcccaggccctttgccgtggccctgcctgctctccagcctggtctcaccccacctgtggcaccttcgctgtggaggataccgtcagccaggctcacagttcctggcaggccacttcctctgtctggggccctgcctgggggtttggatcacctgagtcctgccccttggcaagcctcttttaacccacctgatgccttcacaacccagctcaggagtcctgcttccccaaggccattccgatggctcctgctggcgattccagggcctgccacctggtggcctgtgcactttgctgtgacgtgggctgcacgtctctccccagcatgggctcaaggtgctcaggaaccaaaccccggtgtctcatccaggactggacacgtggtgagagctccatggagcttaactgcatgagggaggcgggatggactctggcttgtagggcacagtctgtgtagcaacaaggaacatacctggtgtttagatcagatgttcaatgactcatgtcccagagaaggggcctgcagccgtattggtcagttggggagcttgtatactcaggccattgaggttgccatggccaccattttgggaatcttttctttgggagttgccatcagaatttagggcattaaaaaagtccttaaatttaggtaatgtttgccttaagcagatggtctttgccttttagaactgtcagaacttgtttacccttcaagctgggcactgtggtaagttgactctttgggtccttggttggaaacatgagaatcccattctggctgactcaagcagacatggattttattcgaaggatgtgggggtggctttgagcatagaggcgttgggatggactgaaccatgggcccaggggacaggcacaggctgcctgtgtatttagggcactgcttgggttgcctggagagtggtttattggcccagattctgccacttcttggccaggggaggcctttcatggacagcctcatcagagtggcagcagagagaagagcagggcaggtcctcaaaggaacactgaaaaggttctctgaaagacaggggcgtagatactgagctggcaataacagcgctgatccactggaatggggaagggcc

SEQ ID NO: 3288 - DNA, 2433 bp, Homo sapiens
ggcacgagctttccccttcaagaagcttagattagtgtgattaaatcagtgtgatacagtggtgataagagatccagcactccactcgacatcattgtccgttgtcatgacaccaagttacagcatttgatcaatggttcctgtgccatgttgcagtacacttggctcatcttagtctttttgtcaagctgcctttcagcgacctggttctgcaaagtggttgtggcagccattggatccacagtggggagctccaggctacactttaaaagaagtggtcagtgtttgagatgacgggcatgccagttaccctgatctgatcactataccttataggtatagaaatgtcactaggtgcccagggatatgtataattattattaatcagttaaaaaataaaataaatgattgagaaaacttcagttgttcatatccaagaagggaggggctgcctgagattcctgatggggagtggggtctcatgtcacccccagtcgccaccatgtgctattttcttcccaaaacttggagcgtggttcctttgctcctttatcttgacaggtggatgccatgaattctcaccattttaagatatagatcaggtgataacacattttccccataaagtttcatagttttttgagttgtctgcatgtcttttctaatgccgtcttttctaacttttctgttcagaggatatatcctggattagatcagataaacacagatctattacatacattgagaggaataatttctgcatttgtttcaactgaacactttttagaaaatgaaatagctcatggttatgaaaagaacacggatgctggagtcagaaaggcctatgttcaaatccctcttactacctgtacttgaataacagcttaggcagtgtggacgaaggctacctagtcccactgagctttttaatcctaagctgcaggaaggggataacacctacctcattagtgttgccaaaataacaaacttatttcgaaagcatcaggcagaataaaccctcaacagaagagctaaggttcctttcttttctctgtaactattaaaatgccaacattttagctaggggatccaattcaaacttcagtattctaaaggggcaggacaggctctcacacagctcctgggctggttattcaaagccaaggtagcccagacatcctcaggtccttcacaatgctgggaccacttgtacatgatctgggaccagtagctgctatctgggactgtggtccacataatcacagaaagaaaaaggctcaagcctgttatgggttggattgtatccccctaaattcccatgttgatgtcttgtctcccagcacctcaaaacatgagcttatctggagatagggtctttacaggggtaatcaagttcaaatgtggtcattagggtgggccccaacccagaatgactgatgtccccataaaaagggagatttagataaagaggcagacactcatataggtagaacactgtgtggacatgaggatgaccatctacaagccagggtaagaggccgggaacagacctgtccctcacagcctcagaaggaaccaaccctgctgataccttgatctctgacttccagcccccagaactgtgcgaggacatactgctgctgttgaagtctgtggtactttgttatcacagcctcaagaaactaatacaaagccactatccaacaaactacaaagaggtacaactcccattttcctacatattctgaagccttacattctcctcatcagcatctgcctcctacaaagcacccccagctccagtggacaccccctgcccttctggactccctccgacctcgtgagcagaagacgccttccttttcttaaagggccagttcaggggtactgttcagtgaagctgagtatgactgaaagtcactaaaggtaactgggatagaacccagtttctggctactgtaaataaagctgccatgaacacttcatgaacctgaaagagccaatccttccaaatggatcctgagtggctaactgggtctaaattcagaatggagccaggtcacaaacgtcttctgcattctctgagaaaccacaggctcgcgtgatttggggactttcatggctgtctgctcctatttatgctccctgatttgatgggtgctgggaagtctcatcttgacttctggatctaacaaatagacttgtgacttgcattgaccaatcaaaaccaaacatacttgcatccctctcacttgcagagcagaccagagtgggaatctgggtgggagctttttctataaaggataacctgtctctctgttctcagggagagcatctttgttttgtactgaaggctgggtctccctggtttgcaaactgcttacaggaataaaatcattctcttttttaaggaaaaaaaaaaaaaaaaaaaaa

SEQ ID NO: 3289 - DNA, 1094 bp, Homo sapiens
  misc_feature (1)..(1): n equals a,t,g, or c
  misc_feature (1094)..(1094): n equals a,t,g, or c
ncgcccttggacttgggcggcgcctggataaacacctgaacctgactgagctccgagccagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccaggttaaaaaagaagtcggcgatgtttccatcctaatcaacaatgccggaatcgtaacaggcaaaaagttccttgactgtccagatgagcttatggaaaagtcatttgatgtgaatttcaaagcacatttatggacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttttataaaaactggaatgtttgaaggttgtactacaggctgtccttctctgttgccaattctggaaccaaaatatgcagttgaaaaaatagtagaagctattctacaagaaaaaatgtacttgtatatgccaaagttgttatacttcatgatgtttcttaaaaggtaattacatcagcttctattacttccctaacatgccagtctacagtttactccaaatcccaccaggagaagccactttaaaaatacctgataaattaaaattcattaatttaattctn

SEQ ID NO: 3290 - DNA, 1001 bp, Homo sapiens
ccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacagagtatcagcgcctttgcttgctgctgtttttgctgttttttgatgctgggaaccaccacctaaagatagtaaagaaaacacaggaagctttccggaaaacaaaaagtcctttctcctgattcaccaaaaaataaaatactgactaccatcactgtgatgagattcctatagtctcaggractgaagtctttaaacaaccagggaccctctgcccctagaataagracatactagaagtcccttctgctaggacaacgaggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgag

SEQ ID NO: 3291 - DNA, 1008 bp, Homo sapiens
tgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgmaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatyccccaaagtcagacacagagcaagagtccccttgggtacamccctytgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatcaaaaaaaaaaaaaaaaaactcga

SEQ ID NO: 3292 - DNA, 3044 bp, Homo sapiens
  misc_feature (2383)..(2383): n equals a,t,g, or c
ctctaagaacctagtggatccccccggcctgcaggaattcgggcacgaggggagactgctgtggctaaggagggcgggaagggccctctgtggggctgccattttggctgggacctaaatgcagtaaaggagcagctacgggaatatagagagtggggcttccaggcagagaagcctgcagtgcaaaggtctgcagacaacgacctgggcgtcttcaagggacacaaggaatcatattgccagaacacattgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaactttttcgaggaacactgctatgtcatcctccacgtcccccagagcccgaaggycacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggycttgacctacagcctccgggacagggaacgtggtggtggtcgtgcacagattggtgtggtggatgatgaggccaaagccccggacctcatgcagatcatggaggctgtgctgggccgcagggtgggcagmctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccacggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggscccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggncacacccatcgtgctggtcaagcagggccatgagcctcccaccttcattggatggttcttcacttgggacccctacaagtggactagccacccatcccacaaggaagtggtggatggcagcccggcagcagcatcaaccatctctgagataacagcagaagtcaacaacttccggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccataaaaaaaaa

SEQ ID NO: 3293 - DNA, 503 bp, Homo sapiens
agtgatccccttgcctcggcctcccaaaatgctggaattgtaagcgtgggcctctgcacccggcctggtccgcaatttaaaaacgcacagccaccattccctytccagaaagcacccagatgcctttgggagaaccagcctcctccatggaggaaagcttgggatctgccttcccacctggggaggagagggatctgtggaaaatccttctgacggacttcccctcagtgcctgatccatactcaatagtagaaaaagtaagaaatatacaaagatagcagatacacggagacagttccccaaatagctgagcgawtagcgcagaagcaatattgaagacctaatagctgagacatttccagaactgataaagtgcatccagccacagatcaagcagcccagaaaattccaggcagcatcaacaaataaatagccccacatgcacccgtgaaaatgcagaagaccaaacaaaaaagtccggtcaacagccagagttaaagagg

SEQ ID NO: 3294 - DNA, 2369 bp, Homo sapiens
  misc_feature (1)..(1): n equals a,t,g, or c
ncagcgcagggagctgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaaggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaagcatgctttgttttatatagagaatatttattttaaaaatatgtctctcatataccctattaattgtattattgatataatctttttggtttccttcagcaattccaaattttccttcagcctttctggatttcacagatttataaaatctttgtgtctttc

SEQ ID NO: 3295 - DNA, 1296 bp, Homo sapiens
  misc_feature (1215)..(1215): n equals a,t,g, or c
  misc_feature (1295)..(1295): n equals a,t,g, or c
ggcacgagcaggaaccccttcctgcccccgttgccgaggcagcactgccctctgctaggaacagctccgtgttggcctctctgtccccacacactgggcctgcagggcttctccgagactcttcagttcaggtatcaaccctgggctgtctcctgggatgtggggggcgratgttctttccttgcctccccacgctcytcytgcggatccttcactccgggtgggtcggcctcttcctcctgatcagctccagagccccytctagttccctggcatggaaacacggcccgggtgarctgtggtggccccggargcctctccgctcctgcacaggccttgcttcctgcgggtgacgaggtcctggactctctcctgcccaggcttctgggtgctttccttagttcagcaccagtgctctgtgtgggcagcgtctcccccgaggatccgcagctccgggttacccgcaggcgtccatctccggtatggtgctgcccttcactgatcctggttgtatttctgtttcctgctttcctcatcgcctcctgtttcggttgattccttctttttgctggtgcccgtctcacagtagcttcctgagaacggggacctggcaggtacacttcagacctcctgtgtctgaaatagtgtcctggttctgacctgcacttgagtgtcggtgaggcctgggcagggttccgggtgggagctcagtttcgtcctgagtttctcaggccccaaccatggcctgtggtggcttcacgggctacaaggcaaaggacgcaaacgaagaggcttcacgtgacagggttgtatgctcagccagctytggaggctggagtctgagctggcagcactgacagggtcagctctcctcggaggctgctggggaaggaacctcctgcctcttccgggctccgggggcctctggcacccccggtgtccccgggcttggagacgcagcactcccatgtctgccggttcccctggccgcctcctctgtgtcattgtctgttctcttcatatagggacaccagtcatcgaattggaggttcactctactcaagtatgacgtcaccgtgatttcactgattttatgtcccaggccgtattctaacaagggcacatcctgtgttctgggaagggcgtgtcgctggggaaatactcttcacccggctgcaacctctcactgtagaactgcctctgtggagaagcccnaagggcatttgcggcttctaggagccaagtaggaggaggctgggatccgtgtktcaggcgggactccaggcttgggcggnc

SEQ ID NO: 3296 - DNA, 1122 bp, Homo sapiens
  misc_feature (5)..(5): n equals a,t,g, or c
  misc_feature (948)..(948): n equals a,t,g, or c
  misc_feature (1107)..(1107): n equals a,t,g, or c
  misc_feature (1116)..(1116): n equals a,t,g, or c
  misc_feature (1121)..(1121): n equals a,t,g, or c
ggcanagctaaccgcagtctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcaggtaggtggggtgtgtgtgtgtgtgatgtggaacatggctgtgaacctgaaccgctttccatgccccctcctctgcagacacttctacaagcccatgcttcgacggggcagcagcaagtggatggccaggacaggggtgttcctggcctcggccttcttccacgagtacctggtgagcgtccctctgcgaatgttccgcctctgggckttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccntatggggctctgtcctgcacccctcagggatggcgacagcaggccagacacagtctgatgccagctgggagtcttgctgaccctgccccgggtccgagggtgtcaataaagtgctgtccagtgaaaaaaaaaaaaaaaaaactcgagggggggcccggnacccaattngcccna

SEQ ID NO: 3297 - DNA, 548 bp, Homo sapiens
  misc_feature (10)..(10): n equals a,t,g, or c
  misc_feature (14)..(14): n equals a,t,g, or c
  misc_feature (27)..(27): n equals a,t,g, or c
  misc_feature (68)..(68): n equals a,t,g, or c
  misc_feature (533)..(533): n equals a,t,g, or c
  misc_feature (539)..(539): n equals a,t,g, or c
ctcgaaattnaccntcactaaagggancaaaagctggagctccaccgcggtggcggccgctctagaantagtggatcccccgggctgcaggaattcggcacgagcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaaaaaaaaaaaaaaaaaactcgagggggggcccsgtacccmattsgcccttgkgrgkcgtttwccattcatggcctsgttttacaacgtcgtgactggggaaancctggngttacccaa

SEQ ID NO: 3298 - DNA, 1631 bp, Homo sapiens
ggcacgagcttgtcgtgtggctctgtgtcgacactgtgcgccaccatggccgtgactgcctgtcagggcttggggttcgtggtttcactgattgggattgcgggcatcattgctgccacctgcatggaccagtggagcacccaagacttgtacaacaaccccgtaacagctgttttcaactaccaggggctgtggcgctcctgtgtccgagagagctctggcttcaccgagtgccggggctacttcaccctgctggggctgccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagagatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattattttttttaatttaagtcctaaatatagttaaaataaataatgttttagtaaaatgaaaaaaaaaaaaaaaaaa

SEQ ID NO: 3299 - DNA, 1803 bp, Homo sapiens
  misc_feature (5)..(5): n equals a,t,g, or c
  misc_feature (9)..(9): n equals a,t,g, or c
gaaanccgntttgagaaaaccctcactaaagggaacaaaagctggagctccaccgcggtggcggccgctctagaactagtggatcccccgggctgcaggaattcggcacgagttcaccacccctcccttctgtatatgatgcttctgtagctctgtaacgccccctacatttaccttccttatatctcccccgtcttcctctccatagatctcctcccatttccccttccatggtccccatcttccttctgaaatgtctactccttcatgttcctttatgtatgtcttccaatctttccttccatagctctcatcaccttcatatatttcttccatctttctcctcccacctgcctcgccctctgtatatacccccactctcccccttttatatcttctccatctccccccatatctttcctctatgtccacatctgtgtattccccccaacttcccctccatatatcttttttactccccttttcctccctgtatcctctgtgttccccccatcttgctctacatcattcttcccaagatctttacgtctcccatcttgatctctccatctccactttctcctaacattttcatttccgttccttagtgtctctagagagatcattcttgatagcctcagctctttctctgtgtttttcaggtttgtattctgctctgctctacctctcctccttgccccttttctctcccaggatgtctctcctttccaaatcctttttgtacctgaataccttttgccccaccctgggctctcatttccatctcagaccttagcctgggatctaaagggctgacagtgtccctttcttcatgcagatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccaaaaaaaaaaaaaaaaaaaaaactcgagggggggcccggtacccaattcgccct

SEQ ID NO: 3300 - DNA, 2716 bp, Homo sapiens
ggcacgaggcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagacggcagatgggcagccggcagagtcacaacagtcaccagtcactcaacagtttggtgacaatctcatcaaaccacgtgccagagaatttctcattagaactcacccacgccactcctgctgttgaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaactaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaagctaaaaaaaaaaaaaaaaaaaaaaaaaaaaaaaa

SEQ ID NO: 3301 - DNA, 1872 bp, Homo sapiens
  misc_feature (1870)..(1871): n equals a,t,g, or c
gcagaaagcaacctcagctgaaacaaatgcataattataatttgatttcagaagtggaaacatgacccgaattcatgcacctactgattactccaaattcctttattgttgaagctggagcagaagtgggggtccaccgtggaagtaaggaaaagcaaaacagaacaggggtctcatccagggagccatgtcgatggctatggggagctccaccttgctcttggggtggggccctggccctgggtgggactgtggggtgatgagggttgtgctatgctggctacctggtggtaattgccaaggagagagcagcacgtagatcctccctgtcatcaggcagagctcttcagtgaggtgggctcagggagggctctgtgcctctgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcwtytywwwkgcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggagcaaagatcacaggattccagaatgacgttccgggagagaactgagaggcatgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcatcagtggtccagggtcctggcttggagccagtgagtagacaggcaagcagaggggacaaaggtagctgggttatacatgaatattctcattacaatagaagaaaataaaagacttaattaagcccaaaaaaaaaaaaaaaaaaaactcgagggggggcccggacccaattcgccctatagtgagnng

SEQ ID NO: 3302 - DNA, 726 bp, Homo sapiens
  misc_feature (3)..(3): n equals a,t,g, or c
  misc_feature (7)..(7): n equals a,t,g, or c
  misc_feature (141)..(141): n equals a,t,g, or c
  misc_feature (660)..(660): n equals a,t,g, or c
agntcantcattaggcaccccagggttaacactttatgttccggttgtatgttgtgtggaattgtgagcggataacaatttcacacaggaaacagctatgaccatgattacgccaagctcgaaattaaccctcactaaagngaacaaaagctggagctccaccgcggtggcggccgctctagaactagtggatcccccgggctgcaggaattcggcacgaggtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaangcgctgccactcagccctcaaaaaaaaaaaaaaaaaaaagggcggccgctcgcgatctagaactag

SEQ ID NO: 3303 - DNA, 927 bp, Homo sapiens
cgagtggacatgagggtccctgctcagctcctggggctcctgctgctctggctctcaggtgccaaatgtgacactcagatgacccagtcgccatcctccctgtctgcatctgtaggagacacagtcaccatcacttgccaggcgagtgacgacattagcaaagatttaaattggtttcagcagaaaccagggcctgcccctaagctcctgatcttcgatgcatccaatttggaaacaggggtcccatcaaggttcagcggaagtggatctgggacagattttactttcaccatcagcagcctgcagcctgaagattttgcaacatattactgtcaacagtatgataatccccctctcactttcggcggagggaccaaagtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcaaaaaaaaaaaaaaaaaaa

SEQ ID NO: 3304 - DNA, 1191 bp, Homo sapiens
  misc_feature (5)..(5): n equals a,t,g, or c
aagantgattttccttactctccaaagcgtcagcattttgaagtttcttttatgaaagtgggggcaagaatcagggtgaaaatgagtgtaaacaaagcccatcctgtggtcagcacccactggaggtggccagcagagtggcctcagatgttcctgcacctggcccaggagcccaggacagaggtcaaatctaggccccttggtctggctggattcatcaggcaagattcgaaaacaagaaaacctctagaacaagaaacaatcatgtctgcagcagatacggcactgtggccctatggccatggcaatcgtgagcaccaagagaatgagttacagaaatatctccaatacaaagacatgcatctcctggacagtggacagtcgctgggacacacacacacacttcaaggctcacacaacctaacagccttaaatatctgaagaaacagaatcacgacattaagtcagcagagggagaggtaggctgaagcagcaggaggccaattttatatcccacagatttttttaaaaatgactccccagcaaggggtggggagaaagccactgatttaggagagttcttggctcagccaaccactgcggttatctacacgttttacaaaggcacrgaagtagagaggggctgcactcacgaccctccccagggcccgcacagccagacacggtgggttcttcctttttcccttctggccttggtggaattcctaccacggtggcctctgcctttgggacaatgccttcatgctcatccccgggtcaaggatggagtctgttaccattttccaggggaaattccaaggaccagccccgcctcattacgttcaccccacaggaaggtgatctggaaagcctgtaaacacgtactctgggtggctgagtggtgtcaccaagctgcttttgtgcagggctgaagcacagacaagagggcaggcagctgccggaggcctgaagtggggagagatccccgcaggcctgcaggagccagggagaacctccaactggatctaaactgtgggacagcccaggcgtgcccctcttcacatggctcccaggctccctcaaagcccttcccaggccctgcaggaagagagggagggtgaggagaggcagggagggcagaggtcgcctgaaagcctgggctccgaactccctcagcagagctttaaagtg

SEQ ID NO: 3305 - DNA, 778 bp, Homo sapiens
ggttctctggccaagaggagcaattttcgtgccatcagcaaaaagctgaatttgatcccacgtgtggacggcgagtatgatctgaaagtgccccgagacatggcttacgtcttcrgtggtgcttatgtgcccctgagctgccgaatcattgagcaggtgctagagcggcgastggcagggccttgatgaggtggtacggctgctcaactgmagtgactttgcattcacagatatgactaaggaagacaaggcttccagtgagtccctgcgcctcatcttggtggtgttcttgggtggttgtacattctctgagatctcagccctccggttcctgggcagagagaaaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgtaaaaaaaaaaaaaaaaaaaaaaaaaaaaaaaaaaaaaaaaggggggggggc

SEQ ID NO: 3306 - DNA, 1071 bp, Homo sapiens
tcgacccacgcgtccggtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttycccatggggctggggtactttacattcaataaatactgtttaacccaaaaaaaaaaaaaaaaaaraaaraaaaaaaaaaaaaaaaaaaaaaaaaaaagg

SEQ ID NO: 3307 - DNA, 2254 bp, Homo sapiens
  misc_feature (1182)..(1182): n equals a,t,g, or c
ggcacgaggcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaastgcagagcaaccccagcctggagggcgtgagccacgtcatcgtggatgaggtgcatgagcgggacgtgaacacagactttctgctgatcctgctcaagggcctgcagcggytcaacccggccctgcggctggtgctcatgaktgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcagagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgnctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtgaaaaaaaaaaaaaaaaaaaaaaaaaaaactcgag

SEQ ID NO: 3308 - DNA, 1101 bp, Homo sapiens
  misc_feature (147)..(147): n equals a,t,g, or c
  misc_feature (376)..(376): n equals a,t,g, or c
  misc_feature (395)..(395): n equals a,t,g, or c
  misc_feature (1101)..(1101): n equals a,t,g, or c
gggcacagctgaagctgcagacctccccaggggatggctcctctcccccaggagccccgaggcaggggaggcagaaagcctgggctctggggggtggcctgcggacagctgtgctgtgggccgggggctgggcctgtcccacagggncgtggagctcgtggttctgagcagccagctgggtggtgtctggggatagctgggaggcacagcggctgccatgtgggactgggactggagtgctccctggtcttggcctctgtggctcagccttgctctggtctgcctgagtgcaggggccaaggggcacagggccagtgaggccggccacgctcgggccctcacctgtgagatggggtcggaatttkacacagcctanggcttggttcttggtkgtngamcgtggactyctkagaacgggagtgctggtcctgaaaggcgtggttggagaccagctgcttttctcgctgtttttctcttaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttaaaaaaaaaaaaaaaaaactttgggggggggccccn

SEQ ID NO: 3309 - DNA, 2506 bp, Homo sapiens
ggcacgagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaaggttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccagtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatggaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcgtaactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgccaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgttttttaagctctttccttaaaaaaaaaaaaaaaaaa

SEQ ID NO: 3310 - DNA, 2054 bp, Homo sapiens
agtgagcagaactgtgttgagatgggagcacatttggttgtgttcaacacagaagcagagcagtggaaggaggcatgcatccccagctgataccttcggttattgctgtagttttcatcttacttctcggtgtctgttttattgcaagttgtttggtgactcatcacaacttttcacgctgtaagagaggcacaggagtgcacaagttagagcaccatgcaaagctcaaatgcatcaaagagaaatcagaactaaaaagtgctgaagggagcacctggaactgttgtcctattgactggagagccttccagtccaactgctattttcctcttactgacaacaagacgtgggctgagagtgaaaggaactgttcagggatggggggcccatctgatgaccatcagcacggaagctgagcagaactttattattcagtttctggatagacggctttcctatttccttggacttagagatgagaatgccaaaggtcagtggcgttgggtggaaccagacgccatttaacccacgcccgagtattctggcataagaatgaacccgacaactctcagggagaaaactgtgttgttcttgtttataaccaagataaatgggcctggaatgatgttccttgtaactttgaagcaagtaggatttgtaaaatacctggaacaacattgaactagaaactcagaaagtggtccttgtgatggaaagagaaaagaaaaaccaattagaataaggcagaatgtacgtgcgtcattggaacacagaaaacatgctggttcatacagcgtttttagtcataatggtcttttttattttgtttgattcattcgagacaacatgtgtgtatgtgtgtgtgtgtgtgtgtagataatgtggtttttgtatggtgtttgatggaaggaataatctttctttgctttcttagtagtatttcaaggtgtttacttttcaattggtgtgcactgaatgcatgtatggaagaatagcgtgaataatgcaatctctttgtcatttttccccttctcagactcttagctcttaaaattcaaagatgggatattctaactggtagtggtgcatcatttttaacccaaatattgcaagcactttaaagatttgaaaccacatttttattgtttgatgtttcattttcagactttttaatgtcagtcattacaattacattgcatgaggaaaatttttccagaacaacagtgtggaatagttctgaattatgctgttctacagatagaaaaaaagtccaaatgcctttaaaaatttacttcttactccacccaacacgtttttgcaaagcaagaagtctttgtaagacaccttaaacaaagtccttcaattctacagcagaggaaataaaatcccccagaagccaaagggctcaccttcacattgttagttcatgacagacccaggtgtgcttcattagagataacatacattccctttggtatcacaggaagttactggggattactcgacctcattacttagctaacgactggataaaatttcttaattatttgaagtaacattgtattcgtgtttgcattattaatttgaatagaaaataatcacattttcaacccatttatacaaattgttaatgtttctttagagctgtataactatagtttgaactagcaaggaagttattgttttgacaaccagaaattatgcttttcctggtgcatgaaacattaattgcaaagggcagtcacatccaactttaataaaatatggtggtctttcttaaaattttcaatttgctaatttttcctggatctaagctgaaaaattccaagcaacagctttttaacctaactttcctactactacttttaaaagcagtatttattttgtaaattagctactgattttttgggtttgaaatactggtgtttgattgtgtggtggtggtggtggtgatggatgcgtgtagctgtgttaaaagctgatacttttagctgaaatggtgctaaataaatttgactgtgtttgccatattcactaaaaaaaaaaaaaaaaaa

SEQ ID NO: 3311 - DNA, 1615 bp, Homo sapiens
cgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttg

SEQ ID NO: 3312 - DNA, 770 bp, Homo sapiens
  misc_feature (757)..(757): n equals a,t,g, or c
tcgacccacgcgtccgggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttratgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaaaaaaaaaaaaaaaaacycgagggggggcccgtwcccattcscccyatatgaattccntttttacaatccc

SEQ ID NO: 3313 - DNA, 1381 bp, Homo sapiens
ggacgagatttcccttatctccttcgcagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtttttatataaggattccaaggcccgcctggtgctcacctctgggattgtctttgtcatctcaggggtcctgacgctaatccccgtgtgctggacggcgcatgccatcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgcaaaaaaaaaaaaaaaaaaaaaaa

SEQ ID NO: 3314 - DNA, 2062 bp, Homo sapiens
  misc_feature (1674)..(1674): n equals a,t,g, or c
  misc_feature (1699)..(1699): n equals a,t,g, or c
ggcagagcattaattgatattttaatatggatagacattgcatagattcaaataaattaaaatcaatgataaatgctaaatattttatctaaatagtttttcaagaaacagttatggaaatgtgtatattraatggctctaatgtggagcttgtggtatttcaactcagtattcattattagttgtgtgtctggaaagattgtacttacttttcctctttacactacagtttgctcttatggggctctaaactgtttaactgaagaaccttcgtctgtattttgattgagcataatttagtattttatgatttccaagatgatgttcttatgtctatcaagtctatgtatcaaatttataacatcatttaagaaaaaggaatttccacagatacttcagttgcaattttttgtttcatgctactgaaaatacatttgtttctaggggttggaatattatagaagatgtaggatgaaagaaaacgatagaacaacgaaagaattctgtttatgaaattacaggaattgtgtccactatggtaaagcattgtcattttagtacattttctcttagtagtttggcattttatactttaaaacttgttttgctttaaaaattgtttataatgcttaccttctttctccagtgcctttagtcttgatttgatatgtttgtaccctcagttaccctttctattacatgtttttgatgttttcatagcctaggaaacatcgattcctttttaataattgtcaatctgattatttaaagaggtaacaattatctgttaatgctttggaaaaacaagtagggttgcctttggaggccaggcttcttarttcattcaaaaatattccttggatttatgccatgtwttaagcatttttagcccccagtattacaactgtgaaccaaacggataaggccctaaccattttcagcattctctttggatggggtgggattggggacttaattaaaatagagatatagaaaaataggcatctaaataagataataagtgtggggttgaaatgaagcatctaacaatagttgaagttagaagtaatattttacagtattgtaacctctatttaagtttgggtattagttacagatagcataaaaaagccttaatttttcactttccttgctggcaaaggtacatttatttagactgtccatttaaagtaatgtttaacataaacattactgtgaaaaacattccattacatattcccaagcaaatgagctgcatcttctttactgtattttacaatttagtacaacagttttaggcctcaatcttaacatcactggtattttaaatttggcaatgaatatgaaattacttttgacttacagattgattatattattactttgaaaatgcattaatttcttagaaaagtttggagcctctatctttttttgagttaatacttaaattctcattacttatattaatagcctgtactaagtgaaaatattatttatgcaagtaaacaagtcactataggcttttaagacttttctttaattttagattttgtcatcaaagtttaaattttttacctactgtccacttrratataatttaacagtttgtaaagtgaaatagtyttaagtatgatgtatgatgcaccggcatataatgaaaatggcgtgcacaangacactttactatgggaactgtacnggaagatttatgaaagcatgtgaaattgcacctaaaattgtgttattagtgactataagcagcaatgctaaatttattgtacttgatgaatgaatgtatttagtcacagttactttggtttaaatgtataaatgtctttagggtttttttttaaatgtgtttgtaatttgtactattgtgggggtatacttggactgcaggggttattgtcaatgtgtgatttgtgtttttattttatagaatcatctaatgtgatataccaatttttataagtgatatttacataattctaataactgtatatttgacaacctattaaaatgttttgcattggaaaaaaaaaaaaaaaaaaaaaaactcgta

SEQ ID NO: 3315 - DNA, 864 bp, Homo sapiens
gctcgtgccgcaacatactacatttatattaaagtgtatttggataataattgccttccttgtatttgtgattgttgcctttaagattttaatatagacaattaatagaattgcttatgcacattttcataaatgggttgttgggttttgtttattttgttataccttgccttgcacatttgtgtccaaaattacatttactcatataaaatcatttgcctgcagtcttttcattatatagtccgtaaaatacagatatttgtctcttaatgaaatataacattcctctatcattagattagattaaatgagtgtatcttckgtaatttataagttaawtggatttaacattttgttgacaaaacacctaggcaccagcagttttgtgtagcccatagttttagtttgaagtagctagaatcctctagtgtacagtttgacgagtttcatctcacctatttaggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaatagtgagtacaaagattggtagtggccaggcttttagctcttcagaggcaagtgtctgtatgcatttgtctcactattcatacttttatttgaagagtctacccacagcatgattaacgtgacccaaagcagactttccccaaaggtaattgctgtggaaaacatggggaagccatttgaacagaagatgcacagttgaggtaaaaaaaaaaaaaaaaaaactcgwag

SEQ ID NO: 3316 - DNA, 2476 bp, Homo sapiens
  misc_feature (853)..(853): n equals a,t,g, or c
  misc_feature (2227)..(2227): n equals a,t,g, or c
actcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaacygccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagtttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcnccccatctaatattctaagtgtcagaggttccgtatttgtaatarcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattrcacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcaggrtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccartgacttttctttaccccccagctgtcggcagtactcagtggaagggtgatatgacactgatactgctattttgaaacctggaggatggaaaggtgcaaaaatctatcaccagcaacagaaggtgcagacygtgttggtggcggtaattttgtccatcaaatgaatatgtgtgaaaacattccctcctttggccctacaggtcagaatggcggcagyggagcatcgtcattcttcaggattgccctrctggccctacctcacagctgaaactttaaaaaacaggatgggccaccagccacctcctccaactcaacaacattctataaytgataactccctgagcctcaagacacctgcsgagtgtctgctctatccccttccaccctcagcggatgataatctcaagacacctnccgagtgtctgctcactccccttccaccctcagctccaccctcagcggatgataatctcaagacacctcccgagtgtgtctgctcactccccttccaccctcagctccaccctcagcggatgataatctcaagacacctcccaagtgtgtctgctcactccccttccaccctcagtggatgataatctsaagaaactaasgaagaataaataaataatataaaaataaaaaaaaaaaaaaaaaactcga

SEQ ID NO: 3317 - DNA, 1340 bp, Homo sapiens
  misc_feature (847)..(847): n equals a,t,g, or c
  misc_feature (1303)..(1303): n equals a,t,g, or c
  misc_feature (1307)..(1307): n equals a,t,g, or c
  misc_feature (1314)..(1314): n equals a,t,g, or c
aattcggcagagagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgacgttaaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgctgccacctctgcccaggacackcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccntcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctcctttyggccartatcataagatggacgccataatcctgaggcctcctagaggctgagggggcaacggtgtgatccagctggctcatcccagccaggtgggccaattattcaattttcaagaattttgttgcaagccagttgtcaaacacagccattataattatgtaaatttgcaaattatgttaaaaacaaggacaataaatattcaaaatgcatccctaawwaaaaaaaaaaaaangggnggccgcnctaggggatccaagcttacgtacgcg

SEQ ID NO: 3318 - DNA, 2102 bp, Homo sapiens
ggcacgagcgaaggatccctgtggtgccaggcaggaatggcctgcttgaagacccagcgagctcccaaggctttcctgctgcttcctctacttctatatttcgctgggctctctaaattgactcagctccaggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagccatgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaaaaaaaaaaaaaaaaa

SEQ ID NO: 3319 - DNA, 1229 bp, Homo sapiens
ggcacgaggtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtcccttccccccaccaaaaaaaaaaaaaaaaaa

SEQ ID NO: 3320 - DNA, 691 bp, Homo sapiens
gaattcggcacgagctcgtgccgaaaaattattatttaagattaaaccatagcatcacattttcagtaatggcaaataaaacttgaatatcataatgagtttatattcatcatcattcactgaaacagtataaaaacaagatctttacattaagagattctacatttttctgtttacttcttgaatattgtcctaatctattttatatttgaacatattttgttgatttctgctaatagaaagttaccaaaaacttagaaataagacaaatttatcattgcatgttttcctttttcatactgaagtaatgtctaaaagattcaccttggattatttgtttctttctgagattgtactttgtttgttttactacttattacttattagggccttggctctgtgaagttggatgttaacttataaatggtattcatagagatacgtgatttatttcaggtagaaaaaacaaccctacaagattttttttttccagcaaaacattaaacagctttgcctcaaacttagcaaatgtatttcatcatgactttcttaaactgacaacataacaaccatttgaattttcctttgaaccagctttaccacctgtggttttcctcattatttcccacattattgagttaaataaatatttgacgtgtgttcactttaaaaaaaaaaaaaaaaaactcga

SEQ ID NO: 3321 - DNA, 1151 bp, Homo sapiens
ggcacgaggagaacaggggcaatgacacatgctccttggcttcctagtcctgatcccttggggttccttgatcctagggtcatctgacttagatccatcctcccttcctctaggcaccaggggccatggctggaggtggccacccctcagtcctgtacagattctgtacccactggctggagacccccatgcagctgtctcctgctcttgctgcggggagactgaactcagggctctgctcactggctccctcccaatggaagccttctctgggcttcacagcattgaatattcctccagaacagcttgttaaatcaaattttttttttttttagatggagtcttgctctgtcgcccaggctggagtgcagtggcacgatcttggctcactgcaaactccgcctcccgggtttaagcgattctcctgcctcggcctcccgaatagctgggactacaggtgctaccacacccagtaatttttgtatttttagtagaaacggggattcactatgttggccaggctagtctcgaactcctgacctcatgatctgtaatcccagcactttgggaggccgaggcaggtggatcacctaagttcgggagtttgagaccagcctgaccaacatggagaaaccccatctctactaaatatacaaaattaggctgggcgcagtggctcacgcctgtaatcccatcactttgggaggctgagacaggtgggtccaaggtcaggagttcaagaccagcctggccaagatggtgaaaccccatctctactaaaaacacacacacacacacacaaaaattagccgggtgtggtggtgggcacctgtaatcccagctactagggaggctgaggcagagaactgcttgaacccggaaggcggaggttgcagtgagccaagatcgcgccactgcactccaacctggacaacagggcaagactccctcttgaaaatataaaaaataaatatacaaaattagccaggtatggtggcgcatgcctgtggtcccggctgctcgggaggctgaggcaggagaatcacttgaatccgggagggagaggttgcggtgggctgagattgcgccattgcactccagcctaggcagcaagagggaaactccgtctcaaaaaaaaaaaaaaaaaaaaa

SEQ ID NO: 3322 - DNA, 2961 bp, Homo sapiens
ggcacgagcccaaaagtgctgggagtacaggcatgaaccaccgtgcctggccatttttaccgtttttttttttttttttgagacggagtcttgctctgtcgcccaggctggagtgcagtggcgccgtctcggctcactgcgggctccgcctcccgggttcacgccattctcctgcctcagcctcccgagtggctgggactgcaggcgcccgctaccacgcccggctagttttttttgtatttttggtagagacggggtttcaccgtgttggccaggatggtctcgatctcctgacctcgtgatccgcccgcctcggcctcccaaagtgctgggattacaggcgtgagccaccgcgcccggcctatttttaccgtttttaagtatacagttcagtagtaataaatacatttctattctttttctcctcccttcaactccccccacccacttcctggcctttgataaccaccagtttatttatctttatgagatttaactctgacatatgagtgaaaacatgcaataagttgtctttctgtgcttggtttatttcacttaacgtgatggcttccagttccatccatattgctgcaaatgacaggatttcatttatttttatggctgaataatattccgtagtgtatgtataccacattttctttaagcacttaggttgacttcatgttttggccattgtgaatagtgctgcaataaacgtaggagtacaactatctccaatatattgatttcctttgttttggatattgctggatattgctggatactattgctggatattgctggatactatgttttggatattgctggatactatggtaattccgtagttttagttttttgaggactctatattgttctacatagcggccttactaatttgcattcccaccaacagtgtatgagtgttccttttctctacatccccgccagcatctgttactgccttttttttttttttttaaaaaacagagtcttcctctatcacccaggcaacctccacctcccgggttcaagtgattcttagcctctgccacccaagtaactgggattacatgtgccaccatgcccagctaatttttgtaaatcccaaagtcctgggatttacaggcgtgagccaccttgcccagccttgcctgtctttttgatacaagccattttgactggggtgagatgatatctcattgtggttttgatttatatttctgtgattatagtgatgaacatttttttcatatagcttttggccatttgtacgtcttttgagaaatgtcagttcagatgttttgcccatttgtaaacgagattatttggttttctgctatcgagtttgagctctttatatattctggtttttcgtccttttttagatagacagtttgtagacactttcttctattctttgtttatctcttcactttgttggttgtttcttttgctgtatagagctttttagcttgatgtaacacccattatctctctttgcctgtgcctttgaggtcttacacaaaaaatctttgcctagaccaatgtccttctttcacttctttggttagattgattcctaggtgttttacttttttttttgctattgtaaatggaattgctttcttggtttctttttcagattgtttactgttgttatatataaatagctactgattttttttaattttagtttttaagaagagatgatgtctcactctgttgaccagactggtctcaaactcctggcctcaagcggtcttcccgcctttcccttcgaaagtgctgggattacaggcgtgagcctaaccaaagcctaaccaaagagtcattcttcttcaaccctctcaaaaccttccaagtgttttttttgtttgttttttttttttttttgagacggagtcttgctccgtcgcccaggctggagtgcagtggtgcaatcttggctcactgcagcctccgcctcctgggttcaagagattcttctgcctcagcctccccaagtagctgagattacaggcgcccatcaccatgcctggctaatttttgtatttttagtagagtcgggatttcaccaggttggccagtctggtctcaaactcctgacctcaaatgatccacccacctcagtcacccaaagtgctgggattacaggcatgagccacaacacctggcctaaaaccttccaagtgttacctgcaattactcaactagttctgatcaagaccaagaaaattaagatcagtaagtaaaagcttgtaagttacagttagctttcaaatttcatgacatatagattttcttagtatacagtaagggaaaataattctttgtaggaccttgtactgtcttactaggtggcattctattgtcttctgtcacagggcttaaataattgtcaaaataatatttaaagttagtactgttaaactctcttaaaaatttattttcctttcctgttcaactcattggaataagaaaagagttgatttagtgatctatgcacctaaggattaaaattcatgttatttatctcccaatattgcttatcttcatgctttaggaatgaatatataccaataactccatttttcaataattcatataatcacatcaaaattcctattttggggtcagtaaatactgttttcaatcttaatttcttggatttacttattagtttagataagtaaaaccttagtggaagttttaaaatgtattatagatttctgaaacatggcaatttgtttactgaggtcaaaacttcagatggagagattattttttaaaaataaaatagttacgtgcttgtagcctttttacataacttgaattgcagaagattttcatttctctttaaaaattattaggcttttgccaagttggaaacgaggtatagcgcctgtagtcctagctacttgggaggctgaggcgggaggattgctcgagggggggccc

SEQ ID NO: 3323 - DNA, 2286 bp, Homo sapiens
ggcacgagatgatggtggtggtgaggataatggttgtgatggcttctcttcaggtggagcctgcagttggcaaagaacagctcagggagaggcagggtccagagctccttggctgggtggctggcctggcttttgtgtgtctctttgcctgtgttggggtgggggtcgctccctgtcactccttcgattctgaagctgcctccttcctcctcctgtactcctggtgcacgcccaggctcctgtcttggctccgggacactccctccccactcgcctccgggacgttccctccccactcgcctctgggagagaggcctttgctttctgggccgccctcttctagtcagcagcttctagttgttggcccctgtgccttgcggtttgtaggtgccaggcatgtgaaaacggctggtttcagggatggcttttccctgccatcttcctctgttttcagtgaattttggaagatgacacttctagaagcgcctcttctttgccatcttagctcgaagtctggagcttctgcttgctggtgagattgaagcagacgctgaggtcctttcacccacctgcctgctttcctctctctcggattccattcctatccaaaactctgtctctatttaaagcagggtccgcaaatgactgcttttaaaaataaaattttatcagcataaagctgtcaccaccatttgcacactgtccgggttctttcccagcacacagtgacttgtggcctactgagcctaattatttactgtctgacattttatagaagtttaccaagcgtgatctaaggtgtgaagagcctctgcttgtcccctgatctgttcccgtcctaggtataatttattaattacacttcttcagtgtgtgtagctgtgcacaggaaatgaatcctgcatgctgttagcggcgagagttcctcctcagggccgttgaggcgtcgctgcagaggcccagccggaaccttcagaggccctgggaacacacagctatgttgccagaacatccctgaagagccgagagtctgctccggattttcaaaccacactgtcagaaatgctttgcaacgctgacattaagcattgctttgtgatggtatttaggaagcaattctgtctgagagatccttgcctatgtgtgacagtaaaacactgtcgcctctaagatctgccccagcagctgtttgctgaggagaaggcagctctgtgagatccatgttcctgtgggctgagctacacggcacctccagagctcctacacctccttcctggtccttctgaggctcatgcgaagcccaggcatggtcagcatctgtggtcacgctggggcctcggtcacgttgtagcttcacatgccacagagcctgctacagggctggctgcatcctgcatcccacccttcccgtcactcagagagagacccacgcttgtgtgaagatgaggaaggactctaaagtgttatgagagacaaataggatcagaaagccaggcacaaaactgtccagagaccgtgagtcccatctgtagacagaaattgttaaaagggactcaaatcaatatgccaaaaaagtaaacattagtattttatgagtaaagtgtaggtaaattgtaccgtatacctaccatgcaccctatactgtacatactgtatgtcttcttttcctgtgccactgaaagagggaaaaaactgccaattaacctgtaaaatgccaacatacataggatgcatccaaatataagatagtaatatgtaagacagagtatttgaattgccctaattttcagtatggaaaattagtactcttgaatggaaattcttcagtaccttcagtactcttgaatggaaattgtcgtactttttcttaactttcattttaggttcaggggtaagtgtgcaggtttgttatataggtaacctgcatgtcaccggggtttggggtacggattatttcacctggtgatcagtatagtacccaggaggtagtttttccatcctctccctcctcctcactccctccaccctcaaccaggccctgctgacttcttgttccttctttgtgtccatgtgtgctcagcgtttggctcccactcataagtgagagccatgtttggttttcttgcctgtgtcagttcccttagggtcatggcctccagctccagccatgttacttcagaggacatgatcttgttcttaatatcctgtggtatatatgtaccacattttctttatccagttgaccgttgatgggcatacagcacttttacaattagaaaaaaaaaa

SEQ ID NO: 3324 - DNA, 282 bp, Homo sapiens
agcttctctgtccagtcttgaactctgggstctcttggaactttcctcacccctctcagcctgaatattccttccatggattccactcaaccagactttggatctgtgcctacttaatcaaccttatctttgcaatatgttcgggcccaccttccactccttggttcttgttcctccttggcctaacttgtcccttctccacttcacatccccggtgggacagcattcctccttcctcccaacctccctccgtctcaraaaaaaaaaaaaaaaaaaaaaatt

SEQ ID NO: 3325 - DNA, 1519 bp, Homo sapiens
tcgacccacgcgtccggcgcgcaccgccgcccgggcagccgctggctccagctcacgaaacagccccgggcgccgcgccgctctgagtccagcctcctactgagaacagtccctcccttgtgcgggtcgcaggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgckcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacacagkgagacggagcatgtttatgagctcttggagaataagatscagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatggattcacttattcggcaaacatttactgggcatgccacatgccagataccgggctaagtatctggcatgtgttacagaaacaaaagacctaaatcttgtcaccaagaaacatgttacatgattttaataagttccctgatagaagagcatggggtgctctggggaaatattggagggtcatccattccacattaaaagagcaagttgtctgcaaaaaaaaaaaaaaaaaaactcga

SEQ ID NO: 3326 - DNA, 2635 bp, Homo sapiens
  misc_feature (2605)..(2605): n equals a,t,g, or c
taagggggtgtgtgctcacctcctcctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggyttccttctggcccctctgaggattccctagggctgccccgcagaggggyttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttyttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatccygtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccayatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggargggtggtgggtggcggcatcttgactgccccctgttgtcccacacgtggggggtggtcaccccycttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgcccygcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaaaaaaacccngggggggggccggtaacccatttcgcctaa

SEQ ID NO: 3327 - DNA, 1094 bp, Homo sapiens
  misc_feature (196)..(196): n equals a,t,g, or c
  misc_feature (226)..(226): n equals a,t,g, or c
  misc_feature (302)..(302): n equals a,t,g, or c
  misc_feature (596)..(596): n equals a,t,g, or c
  misc_feature (952)..(952): n equals a,t,g, or c
ggcagctttcttacaaacccatccttctgaaatgttgcttcaaattcatcctctgctccccagtcccactattccacacatactgttactgtttctttatcctactttctcaattttggaacatagttgcagttactgcattgaatacctgtgggtttgcctgttgttctgtctgtctctgtggttcttgtaatantggatcccagagataaaatggacagttgtnatgcacagttaattcagaaactagaccttacttgctgtgtgaaataccaactaaattctcagtgaactcagctganctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgatttccctgtattattataagcaaagcaaatttgaggaaaaaaacccataataccacacctcatttttttcaagtaatagggtcataagtctcatyctycatataatatgttgagtatgcagtatattatgtgttaggctctgganaggcagaggttagatcatgtwacagatcatatckgattaggcagataaacagtattttaaccttttccttattatatgtaacttgctttcaggttttttaatgttactattatgtctttaatatattatctttatttgtacttttgtatacagagtgattttccttttttaaaaaaaattgtgtctttaggatggattccaaagatgtggaatcagtaggtttaaggaatatggatattttggctggcaaggtggctcacacctgtaatcccagcactttgggaggctgaggtgggtggatcacctgaagtcaggagttcgagaccagcctgaccaacatggcgaaaccctgtttntactaaagacacacwwaaaattrgccagtggtggtggcatgtgcttgtagtcccacttagctactcgagaggctgaggcaggagaatcgcttgaacccgggaggcagaggttgcagtgaggcaagatggcacctctacactc

SEQ ID NO: 3328 - DNA, 658 bp, Homo sapiens
ggtcgacccacgcgtccgttttctagtctatgcataaactagaagaatgtgagaaaagactattttcagttgctcatgtttacctggatgaactagtttaatttttgtcttttaaaacagacatatttattttaaaattaaaatagcttgaaattttaaaatacaccccaaagcaagatgatcgtttaagttaagttaaacaatacaatgaatggtcttttatttttggtgatgattgccaaaaacctcttgccttcaggaaataagcaataaacctgatgaattgggcatagttgagggggaaaataaaaatcaatggcttctatttaaaaaacacagtatgtaatatctaaaaaagaaaggcattgtttctgaattggggtgaatgtaccaaacatataccaaaaggaaggcattttgttagaaaatttgattaattattagaatcttcctgactggagatgtaaattatcttgttttaaatctaactcactctaatttggttttaatgttgactgtaatccaggctgtttctggggacaacagaacacaatatacctctttattcaaaccacacaatcttggccagctattccctactccagcctgaatgacagaaagagaccttgtctcgaaaaaaaaaaaaaaaagggcggcc

SEQ ID NO: 3329 - DNA, 1821 bp, Homo sapiens
  misc_feature (1801)..(1801): n equals a,t,g, or c
tggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcasctgaatgttgctggaaataaaaccttggtttgtmaaggctcytttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaggatgagtttgttgttttttgttttgttttgttttgkttttttaaagacggagtctcgctctgtcactcaggctggagtgcagtggtatgatcttggctcactgtaacctccgcctcccgggttcaagccattctcctgcctcagtctcctgagtagctgggattacaggtgcgtgccaccatgcctggctaatttttgtgtttttagtagagacagggtttcaccatgttggtcgggctggtctcaaactcctgacctcttgatccgcctgccttggcctcccaaagtgatgggattacagatgtgagccacccgtgccctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgaaaaaaaaaaaaaatttaaaaacycggggggggcccsgwaccccattngcccctaagggggggggttt

SEQ ID NO: 3330 - DNA, 932 bp, Homo sapiens
  misc_feature (43)..(43): n equals a,t,g, or c
  misc_feature (458)..(458): n equals a,t,g, or c
  misc_feature (465)..(465): n equals a,t,g, or c
  misc_feature (494)..(494): n equals a,t,g, or c
  misc_feature (501)..(501): n equals a,t,g, or c
  misc_feature (515)..(515): n equals a,t,g, or c
  misc_feature (582)..(582): n equals a,t,g, or c
attccaatcaggtaataggcagggtatagggaaagcgggtacncctgcaggtaccggtccggaattcccgggtcgacccacgcgtccgggtatggggtgttgtcttgaatgtgtgtggtcctggggcatggggtttggcagaacattctgtgaaaatggaatacatatatgttttttttcgtgacactttttttyttttgcttttggagatttttcaatttggctccaggacctgtatgatgttttcaagctttgcagagatgctcaagatatgactggacatttttgaaagttcctgtgtcctcttcaacacatcttctcaccaaacattaattgtagtgtcttttcttccagaaaacttgcataaaatgacttcctctcctgtgaaaacagtgtcctgctctgaatgggagctttaaaggagtaggcacaaattgtaagatgatgtatcttgaggnctggggncttagagatattctgctgcctcccagagnctttgtngcagacgggtctgnccagggtggggaaagggaagcctccgttctttttggtaagctagccataaagacaggtaagggagtnctattttcaagaaagctggatctgtttcgtactctttctgcccctaatcgctgtggacagctcccagcagcacaaagagatgaagggcaaaggcaggatgcagcaggcaaagttaacattgtatttgtgagtacagttgaggataaaaaagggatgaaatccacggtgaggaccatcatggtgggggaatagtttattctaatggattcaagagctttggagaccaaactaacacatttatttttatgtgcagttaaagtcatagaaacctgttttgtgaaacctcagatttctaaagaaaaccagaagcaagaccttccttggtttaaaaaaaaaaaaaaagggcggcc

SEQ ID NO: 3331 - DNA, 1626 bp, Homo sapiens
cccacgcgtccggagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcactgtcagacgccgccaagtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaaattcaaaactggaagcaaaaacttgcttgatttttttttcttgttaacgtaataatagagacatttttaaaagcacacagctcaaatcagccaataatcttttcctattgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttcctctttggaatgtaacaataaaaataatttttgaaacatcaaaaaaaaaaaaaaaaaaaaaaaaaaaaaaaaaaaaaaaa

SEQ ID NO: 3332 - DNA, 622 bp, Homo sapiens
ggtcgacccacgcgtccgttctcatcatgttatgggtgaaaacaaggagagaagagctgcggcccttcggggaaccgagacctggaagctccctgaggcagggctgtgactccctctttggacctcttaagttcctggagtctcaagcttccagccgccaccatgtttcctggtggcagctgtggaagctgcttctggtgtgcctggtccagctgcagccttgcagagagccggcacccatgcagacaccttgtgctggctgccccgctgcagcagctggggtgcctcactgtgtgcagtggctggaccccatgctcacttgctcacacacccctcactgctccacacctggcttgccgttggcagtgatgggatccaggctggtagcgtgagctgagcacagcctgctcaagccaaatggatggaacaaacccagtgggccagagcagaactcaggcaaaggtgccaccagccacagaggcttctggscagaaaagcaacaccctgaggatcctgcaacagtagttttacaaagtgtttattttgtcatataaaaatctggtttttaatatttgcaaaaataaaagtaaggatgaaaaaaaaaaaaaaaaaaagggcggcc

SEQ ID NO: 3333 - DNA, 723 bp, Homo sapiens
gggcgacccacgcgtccgctcagcctttgttgagagtgctgtgccccaaatctggttggcttattctaggcattcgagtctcttcccaaataccaccttctcaagtgcagcttttccttactacttaattttatagtcccccatcaatgtacgatgttaccctcttttccttcattgagagtgtttgtaatttttttttgtctgcttgtttattgtctttttgccccataagtccaaggtttacatgaacagggaacttgtctgttttgtttattactgtatcccctatgctggcacatactatgtaataagtgtttgttgagtgcatgagtgaataaccattctaaaaaactctgatgtttaaagccctttgctttatataagaattttacttggaaccctggtattttcgtttgtatttgtttgttaataaatgtcaagagttcagtagtaagataggtttcagaaatgctaagttaaacagaataaagaaagaatatgtattacaggtcctggcagagccttgaatatgctaacatttgacagtgggagtctttgagaattatcacatgaagctgctgtacattacaacacattctaggaaatgctgtcttagacaaaaacctgtcatattagaattggggtaaggggcacgatactgaccgtgaggcagcagattcctatggactacattaaaaaaaaaaaaaaaaaaaaagggcggcc

SEQ ID NO: 3334 - DNA, 1236 bp, Homo sapiens
ccacgcgtccgggagcttgtttttgaatcatgtcacattttgttctatttttaattttactcatactttcgttaagcaaagatacaaacctatggatccaagtgaagggttaggtttggcattcagtaacctctcctcgggtaagcatattccctgaggcagctcccttcagaccctctcaggctccaggagtgcattactttcctgtggctgccataacaatgaaccacagactaggaagcttaaaacaacagaaatttattgtctcacagctgtggaggccggaaatctgaaaccggggggtcagcaagcagggccgtgcccccctgtgaaggctttagggaaggatcctgtcctgcctctccgggcagctggtggttttctggcagtccttgggttccttggcttgtggatgcgtccctcactctgatctccgactccttcacacggctgccttctccctgcgtgtctgtgttcatgtggccatctccttagaaggacaccagtcatggtgggttaggggccaacccagtgacctcatggtgactaattaatctgcaacgaactgtgtttccaaacaaggtcacattctgaaggtgctttcaagttaaggacttgcagcctatctttggggtccctcagcccctaaccagggcaccccactcctccggaatcaactcccttctgggcaggcgccccggccctggttgctctgctcccctgcttagccgtgtgctgccccagcttgacaagggagatgggtctgcgtgcatctcagctgcagaaaggaagccctcaccttcctttcagttgctgctgggtcatcaccgtcactcctgcagcagggcaggaccaggtcctacagaggccaccggcttgtaggggcctcgggaagcaagttggacagtccaaagttgtgaaaagtaggggccgtggagccgggcatggtggctcacgccggccattctagcgatttgggaggccgaggtgggcagatcacgaggtcaggagatcgagaccatcctggccaacacggtgaaaccccgtctctactaaaaatacaaaaaattaaccaggcgtggtggcaggcgcctgtagtcccagctactcgggaggccgaggcaggagaatggtgtgagcccaggaggcagagcttgcagtgagccgagattgcgctactgcactccagcctgggcgacagagcgagatgacgtctcaaaaaaaaaaaaaaaaaaa

SEQ ID NO: 3335 - DNA, 700 bp, Homo sapiens
ggtcgacccacgcgtccggaatatttaagggtaaaatttttctacttttaaagcttaaaaaaatgtttttttactactgtaaaagtaatgcagagaaatgttcacttaccaaacacatacctttgtaaaaatcaccacttaaagtttgtttctaaagattttaggacaccaagatgcaaataatatttttggctgttacctgctctttcactactgctgagtctgcagtggcaagatagctacacagtacctcagccctcctgctcagtttttaacatctattgataatactaattacaagaaaatttaaaatgtctttttgcaaaaagataccataagcagtcaaaacacaattaaaaaaaaaaaagagagagatgtaaacaattactttccggccgggtgcggtggctcacacctgtaatcccagcattttgggagaccaaggcgggaggattgcctgaggtcaggagttcaagaccagcctggctaacatggtgaaaacccatctctactaaaaatacaaaaaaatagccaggcgtggtgacgcatgcctgtagtcccaggtactcgggaggctgaggcaggagaatcgcctgaacccaggagatggaggttgcggtgagccaagatcacgccactgcactccagcctgggtgatagagcaagactctgtttccaaaaaaaaaaaaaaagggcggcc

SEQ ID NO: 3336 - DNA, 832 bp, Homo sapiens
gctataaccaaccatgctagcaaacttcacactgttcattctgactctaatatcttttctgctgttagtctgttctccgtgtaaacatctcaagatgatgcagctccatggcaaaggatctcaagatctcagcaccaaggtccatataaaacctttgcaaactgttatctccttccttatgttatttgccatttactttctgtgtataatcacatcaacttggaatcctaggacacagcagagcaatcttgtattcctgctttaccaaactcttgcaatcatgtatccttcattccactcattcatcctgattatgagaagtaggaagctaaaacagacctctctttcagttttgtgtcaggtgacgtgctgggtgaaataacagaaaccctcaactccatagattcacaaggggagcatggtgtgtcttttagcagaaaagaaactgatggtgtctagaacgttttatatttctgtcagtttgttgtagtgtatgtatttgagtaatttcaaaacagattcctaggatagtcttttatatatatataatatatataaaattcatatatatataaaatacgtatgggtgtatatgtgtgcatgtgtgtgaataataacattgaccataaattatgaagcctagtatatttcatatatataagtatgtgtattttatgatagctaattgtatgatatttcatttgaagaatttatctctctttgtaattaagaaattacagcatttatcagaaaatcattgctgttttccattgtaatttgtaccacatacatgtacttaactatcaaaaaaaaaaaaaaaaaaagggcggcc

SEQ ID NO: 3337 - DNA, 742 bp, Homo sapiens
ggtcgacccacgcgtctgatatgatctccttatccttctccctttgattgatctttttctttgagctgatttgagctttcttcttttctctgtagttggcggaatcagctcagttacattttttactaagttacccacattctgacactccttgacagtkttaagatcttcttctaacacacttgaatagaatggatactggaatctattttgacagctgttgaaaatctattctgttgttacaggaggttaaggaggttatttgtaacactgggattatttaatgaaccttttgaaaaggtgtgcagactgttcaggcaaatagtattttttagaattaaatgattttggttttcacagttaaattatcaaatgtaatgcttttaagaattatacacctagtaatatttttcattaatttctccaccagtgtagtaatagtacattacaatgttctcaattaccggtgccttctaaaatgcaggtgtagagtcyttaaatacagctagtctatkgccagctgtcccatagataaccttctcyttaaaartgaccttkgrgcaattycataaagaataaatatttctagttttttgttgctgaactgctaaaagatggttctatacatgtaacaggtggctttagttgggttgctttcactgaaatttgattcaaataaagcattgcattattttacctttggaattataaaaaaaaaaaaaaaaaaaaaaaaagggcggcc

SEQ ID NO: 3338 - DNA, 719 bp, Homo sapiens
  misc_feature (11)..(11): n equals a,t,g, or c
  misc_feature (39)..(39): n equals a,t,g, or c
  misc_feature (657)..(658): n equals a,t,g, or c
  misc_feature (681)..(681): n equals a,t,g, or c
  misc_feature (703)..(703): n equals a,t,g, or c
  misc_feature (717)..(717): n equals a,t,g, or c
agaactaagtnaatccccccgggcttgcaggaaattcgncacgagtatggcttcacaagtaccctcatctcctttccagtcgttttttgtttttgtttttgtttttttgagaccatctcactctgttgcccaggctggagtgcctcttcatttttatttctttattcagcaagtattgatcaaatgtgctttgtaccaggtactgagctctwcgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcgggtggatcacgaggtcaggagatcgagaccatcctggataacacggagaaaccccgtctctactaaaaatacaaaaaaattagccgggcgtgggggcgggcatctgtggtcccaattactcgggaggctgcagcaggagaatggcatgaacccgggaggcggatcttgcattgagccgagatcgcgccactgcactycagcctgggcsacagaatgagactycatctcaaaaaaaaaaaaaaaaaactcgagggggggccccggnnccccaattcggcctatagggagncggattacaattcactggccgncggtttaacaacgncg

SEQ ID NO: 3339 - DNA, 749 bp, Homo sapiens
gccaaaccagrtaataatttccttataatacatgaagtcgttattttgcatttattttcttaggtggccaatggggttatcttggggggagacttttatactcctaagggacagcttggccattaactttcaaagtttctctaaagcagcgtcaggagatatatttggttgtcatgactagtggcattccactgacatgtaatgggtagaggctgggtagacatcctacgatgcacaagacagcctcccacaataaagaactgtgtggcccaaaaatatcagtgatgctgagattgagaaacttaaagaaatttaaaaattaactctatacaaaatctaatgtttgagttttctccatgtatctgtgactgcaatgaccagagtgactgtccataaagaaagtgctaagagttggctgggtgcggtggcctacacctgtaatcccagcactttgggaggccaaggtgggtggatcacctgaggtcaggagttcgagaccagcctggccaacatggcaaaaccccatctctactaaaaaatacaaaaattagctgggtgtggtggcacgcacctgtagtcacagctactcaggaggttgaggcaggagaggtgcttgaacccgggagatggaggttgcagtgagccgagattatgccattgcactccagcctgggtgacagagtgagacaaaaaaaaaaaaaaaaaactcgagggggggcccggtacccaattcgccctataggcagtcc

SEQ ID NO: 3340 - DNA, 1725 bp, Homo sapiens
  misc_feature (1621)..(1621): n equals a,t,g, or c
  misc_feature (1692)..(1692): n equals a,t,g, or c
  misc_feature (1718)..(1718): n equals a,t,g, or c
aaggcagtgatgggaagaaacatccttattattacagttgtcacgtgtgtggatttgagaccgagctcaatgtccagtttgtcagccacatgtcactccacgtggacaaggagcagtggatgttttcratctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaastmaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgmaagcgcaaggacaatctcaacctgcacaagaagctgaagcacgccccacgccagaccttcagctgcgaagagtgcctgttcaagaccacacaccctttcgtyttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagacaaaaaaaaaaaaaaaaaccacaaaacttaaacacaaccccagcaggtgtatgttgctgcaaaacctacagaccccgatgggtctgggaacatgtgtactgtatatcctttcagtaaggaatagaaaattggctctcgggtggtatacctattngcattggacctggaaagctggctttttatccaatctttcaagagaggtgaccctactggcatactttctancttcagaggcatggctcccccaggcnacccaag

SEQ ID NO: 3341 - DNA, 2195 bp, Homo sapiens
ggcacgagaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacgtgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcagctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaatcgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccaaaaaaaaaaaaaaaaaaaaaaaaaaaaaaaaaaaaaaaaaaaaaaaaaa

SEQ ID NO: 3342 - DNA, 1715 bp, Homo sapiens
  misc_feature (17)..(17): n equals a,t,g, or c
  misc_feature (34)..(34): n equals a,t,g, or c
  misc_feature (40)..(40): n equals a,t,g, or c
cacggcctatggtttangttaaaacccttaattntttttncggtaatcacttttaacactgctaatggaaattatgttttcatgtgtttcacatgaaaaagtatatatatacaaggttaatatagtgggtaaaatactttacatagtcacacatttacaaatttttcaagaggttagccactaagactttaataattttacaagggaaaaagcctttttttttytttgatatacagttttttcttcttagttctgcattagaaatggcatctgttttaggtctcaaaatataactcggctgtttcactgtatatgtacattgttttctgtaggaataggrtaatgatatataggatcatgatattccttctatccatgtgccaaatgggtgtaatgtttatttactgatgctttatgttaccaaaacatacagtaaaaaagtagaaatttatgaaatacytttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagrgttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaaaaaaaaaaaaaaaaaaaaaaaactcgta

SEQ ID NO: 3343 - DNA, 1321 bp, Homo sapiens
ggcacgagctcactgcctgtggccgctccctcttcctcttcgatgagatggacaagatgcccccaggcctgatggaagtcctgcggcctttcctgggctcctcctgggtggtatacgggaccaattaccgcaaagccatctccatcttcatcagcaacacgggtggcgagcagatcaaccaggtggcattggaggcgtggcgcagccggcgggaccgcgaggagatcctcctgcaggagctggagccggtcatctcccgcgcggtgctggacaacccgcaccgtgagtctggctcagcagccccctcccgggcagcttcaccccacacccaggggccaggctctcccggggtctcatgctttgcccactgacccggcagttctgagcctggctttggcactcccagctttgtgactttgggtgagccttacagcccctgagtcctacacccagaaggcggctgagggaactgaggccagcatttttcctcctgcccctgggggtttggggccggcttctcccctcttgtgaagcacaaagtcccctccccacctacccttcctgcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccag

SEQ ID NO: 3344 - DNA, 1337 bp, Homo sapiens
  misc_feature (1335)..(1337): n equals a,t,g, or c
tcgacccacgcgtccggagcgacctctctgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaaaaaaaaaaaaaaaaaaaaaaaaaaaaaaaaaaaaaaaaaaaaaaaaannn

SEQ ID NO: 3345 - DNA, 1722 bp, Homo sapiens
  misc_feature (2)..(2): n equals a,t,g, or c
  misc_feature (413)..(413): n equals a,t,g, or c
tnactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggrcaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtngacagcacactgaaggtgtgggatgtgaaggcccagaagctggccatggacctgcccggccacgcggatgaggtatatgctgttgactggagtccagatggccagagagtggcaagtggtgggaaggacaaatgcytccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaactaraaaaaaaaaaaaaaaaaaaactcgagggggggcccgtacccaattcgccctatagtgagtcgtat

SEQ ID NO: 3346 - DNA, 763 bp, Homo sapiens
  misc_feature (1)..(1): n equals a,t,g, or c
  misc_feature (763)..(763): n equals a,t,g, or c
ngcctgccctgcccttcctcctgcagagagccaggttcacagcagggcggcctgcaggacattagcatgcctagtagatacacagtgtcgttggggcgtgggcattttgtatttctgttccttctttttccctatttaactatcatgtttggggacctttgcctctcaatttttaagagattaaaaaaaaatgagagcggcctttattatacactacatgtgttttctcccagtttgtcagttgtcttttgcctttttgggtaattttgccaggtacttatgtcaacttggcatttaagatgttcccctattaataaaagtaatttgctctcattgtatgcaattaagagaatactaaaatttctaatgatcctaccacttaaagctgtataaacgctgctaacataccaggtatcccattccaggcttgcttgtatgtgtatatatattaatatttatctgtagctgtatgtctgtgacactctaaattattaaaaatttgtcccagtggcttacaaatttttttttgtagtagcagcagcttttaaaaaatacaaatcttagcatagttaacagaaaaaaagagttgctccggttaaggtagattctaatccccaccagggcccctgagacatgtccttaaattgctacaaaatgtacaacaaaccactagtaaagtttattctatttgataactctgtttgcttttaaaaacttcatgtatagtgattattttcctgttattctgtattcttcacctgcn

SEQ ID NO: 3347 - DNA, 1039 bp, Homo sapiens
ggcacgaggttgttctgagaattaaatgagttactacacttaaggagtttagagcactgttggcatgcagtgggcagtcaaatgctggctattccagctgtgcatggattccagcttggccagtcttggatgggctgagaaaagggagctgcttttccctaaaagaccatcccaactgtgctctaccacactttgctctcctggctaagactcagagacagatgtatgtatgcccctgagcaatctctttcccttctctggatctcgattccttgcttgtataatgacctggtagtgtaggaccaatgttgctgggtgcggtggctcatgcctgtaatcctagcactttggaacgccaagcacgagaatctcttgattccaggtgttcaagaccagcctgggcaacatagcaagaccccatctctaaaaaaaaaaggcaggcgtgatggtgcacacctgtagtcccagctactcaagatgctgacgttgggaggatcgcttgagcctgggagcttgagccatgatcacaccactgtactccagcctgggtgacagagagggactctgtctcaaaaaatgacccactaggaccagtgtcactttcttttccctctaactgcttaaagctgtgatgctcagtaggatagccactagccccatatggctatttcaatttaaataaattaaaattttaatgctatttcaatttaaataaattaaaattttaatgctattttaatttaaataaattaaaattaagtaaaatgaaattttcagttcattagtcacattagctatatttcaactgctcagtggccataggtggctagtggctcccatagcaagtggtacagatgccaggacatttccatcattgcagaaagttctattaaacaggctggcatggtggctcatgtctgtaaccccagcactttgagaggctgagggggcaggatcgcttgaagctaggagttcaagaccagcctgggcaacaaagtgagacccccatctctacaaaaaaaaaaaaaaaaaactcgag

SEQ ID NO: 3348 - DNA, 1219 bp, Homo sapiens
aacgcactcaatattcagaagtttgaattctaccactctcaaacacagttcaaaagatagctgtttgagaatgcttcttaactaatactagtacaatatcttcaataatgtatgtaccttatagaaaatcttgaacagtacaagattttcataattaaggcatgcaaaactgcttgggctctttgattccaggtgtcctcttctcccttctgcttttgccatctatgttcaatataattctaacccagtctaagtatggagaaaattcctaccctgcctgcttttatagctcatcaaatttccctgtatcagctatcacttttctggtaggtgtagtctgatttctgtctgtcatgcctttgccacaatcctttctttgaagagtaggtaaaagatctattaaagtgttaatcacattgctctaatatataaagcctccagtggtttcccatatcactctgtaaaatgccccttgccagcctctcccatcaacctcgctttttctgttcttgtatatgcacatctcttcctgagcctttattgccatcctcatgtggggatgtttctgtctcagagatagtctttattcaggtcccactctgcagtcctctccagaggggctgctttcaccaccccttctaagtaagcctctctaaacacctctatcatattctatcccttagccagcactaattttttcataatgcttaccactaactgaaatttactttatcatttaatctcttcctcattagaatgtaagctcgtaagggaggggcagctctgtagtttattcattattgtatgtccctcacctaatcctatgagtgtctggcccatattagggtatgtaataaatattacttgaggaatgaatgaatttaacatactaccaattctctgagtgactctttttaaagccttcatcatcattcacactttcttgtctttcatatgggcatgtccaatcacccttccatgaatatctgtacctgttacaaagagaggactaggttcctggagttcatagatgtaaacaacatcctagggktagcaaactggtgggccctgagccaaatcctggcctgcacatgtattttgtttgakttgtacaatgtttgttataaatgaactggctgataatattttttaattggaaatgtttacattaaaaacctaracttctagctgctcttaaaaaataaaaatacggctgggc

SEQ ID NO: 3349 - DNA, 1091 bp, Homo sapiens
  misc_feature (1079)..(1079): n equals a,t,g, or c
ggccagtgggcagggtcacagggcaaggtcccgcgggccgctgggtgcggcgacttccgtgctcccggcgagcgggcggagagcgggggccgcactggggagtgtgggctgggccgcagatgtcatgtggcctgtkttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccawaaaaaaaaaaaaaaaaaactcgngggggggcccgg

SEQ ID NO: 3350 - DNA, 1340 bp, Homo sapiens
  misc_feature (851)..(851): n equals a,t,g, or c
gatcaggagccactcctgtgctaacagcgagaacgctttggtgaggacggagccctcacgacctcagcagtgttgcgttggggatcaggtttccgatggtgaacttggggacacgtccacaccacagcacgtgcctattgtgtttctcggtggctggtgtgtttgaggatggcgcgtgcatgcgttttccagctttctttgtggaggaagttacctgtgggtattaacctgtccccagccatcctctcactgagcttgggttgcctgggcctgggtttcctgttgttgctggaacgaatgaccacagacagtggcattagacagcgcagcagacatgacctcctgggcttctgcgggtgccaacactgccgctccttctggaggctcagggargctcttgagggcattgggacatcgtgctgccggccgccgggcagagccggtttgtttattttttgagacttccgggaaacatagttataaataactttaatttgccttggcctgcccactgcagtacagtcacgtgtcacataacattctgtctaccgtggaccacatatacgaccacgcggtcacataagctgacaatactgtatttttactccactttctctatttagatacacagttgccattgtgtcccagcagccttcagtamtcagtacagccatgtgctgtgcaggtgtytagctcaggggcatgrggccmtggcccagcccagtgtgcagtgggtggcaccttctggatttgtgtcagtcamtgtggagttcgcacaatgacagaytcacctgggaggccttccgtgsgsttctgtttctttctctmatttgattgtggctagaaacagnstgggaaccaggagtgcagyttctcggagtamgtggctgccccacggggtgggatgtgcattttcagtcacatttggggagagcacgcgtgttcttaagtttttagtgggttctagtaagaatggatgttgatttttagaattctctcctgtttattttttaacattttgtggtgggaatttgtgaaagaatacgaagtcaagagcatggtacggtgaggacccagcaccatctccaacctccccggggtccacgtggggtctgcgtgtggccgcctgtccctcagcacgatgtctgggtgtaaatctgagacatcacagcatgcaggctgcagacgtaggcatctctacaaaagaaggatgcgtttacaggagaatcgcttgaacctgggaggcagaggttgcagtgaatcgagatcatggcactgccctccagcctgggcgacaaagcycagactccgtctcaaaaaaaaaaaaaaaaaaactcgag

SEQ ID NO: 3351 - DNA, 878 bp, Homo sapiens
gcccacgcgtccgcccacgcgtccggagtacgctcgggagccctgcccatggcgaattgtggatgattgcggtggagccttcactatgggtgtcatcggtggcggagtcttccaggccatcaagggtttccgcaatgcccctgttggaattcggcaccggttgagaggtagtgccaatgctgtgaggatccgagccccccagattggaggtagcttcgcagtgtgggggggcctgttctccaccatygactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccwaaaaaaaaaaaaaaaaaaytcgggggggggccccttaacccatttgggccttaaggggg

SEQ ID NO: 3352 - DNA, 954 bp, Homo sapiens
gaattcggcacgagaggaagagcgccagagcctgctgcccattaacaggggcacagaggaggggccaggcacttcccacaccgagggcagggcctggccactccccagctccagtcgcccccagcgcaccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaaaaaaaaaaactcgaggggggcccgtacccaatcgcct

SEQ ID NO: 3353 - DNA, 1452 bp, Homo sapiens
  misc_feature (283)..(283): n equals a,t,g, or c
  misc_feature (596)..(596): n equals a,t,g, or c
  misc_feature (607)..(607): n equals a,t,g, or c
  misc_feature (1275)..(1275): n equals a,t,g, or c
  misc_feature (1284)..(1284): n equals a,t,g, or c
gaattcggcacgagattaagttgtgcactttaattgggtgaattgtacatgtragttatatatctractgtagttgtwattaaaaaacaacaggaggccatgtgggctgctaggagtagcaatgtctgtycccagccagcaggtagagaccagggctggacagagkagtatgggctgtgctgcagattatttgtggtacccaactgttgcataaaacagggtgtgatctcttgcattgctatgcatgagtggattcccagtaaattgtgccaggctgcctgantgatgtgtggcttgtgctttggatcgtaatgcttacctatgctacttaagttacataccctgtggcctttgtggccaggactgtgggctactacctgkagtgattcgttaggggaaaggacccacagcctgtgcaggaggaaaaaagcatctctgagtacagggtggatgagctggatgagctgccgggcaagagccacgcacacccaggtggtgagtcttaaggataaggtggaatttgccccatagctgtcctggacagaaactgcccagagaagaatgaatggaggacatagggctctgtggtcccaccnttttttggganacctgtgactggtcctgttaccatgtcaacttagccccaaacccatctctgattgacttggttgcttattttggcacattcttgctccacacagccacatacatactggctgctcctcsaaggccaggcagatgcagcagctgttgggccagcaaagaggaargtcctggaaggttctggcctgaacgctgcatctgttgtgtgacagccacaactgctcaggcttccttgtctgtgggtgcactgtggggaggagtgttatgataagaacattggctctcagtctccctggggagaagtttggcctcacgtgggatttgggcgttgcctttaggaaggctctctgcatgtctagttccagtttgtactgggaagaattaaaaaagtctgccagcttctttagtttgtcctgtcttttgtgatgattctttctgagatcccctcctatcagctcaggagtgggattttctggagaaggaaagtgtttttctgttcctcactgctcaccttggggcattcaggaacatgggcctgatgaatttgcttgaaggcagtctgtaatcccatcactttgggagccaaagargcggatcatttgagctcaggagtttgagaccagcctgagcaacgtgacaaaaccctgtctccaccaaacaacaacaacaacnacaacaacnacaacaacaactacaacaaactgggctggatggcacgctcctgtaatcccagctacttgggaggctgagatgggaggattgcttgagcccaggaggtcaaggctgcagtgagccatgattgcaccactgcattccagcctgggtgacagagggagactgtttcaaaaa

SEQ ID NO: 3354 - DNA, 486 bp, Homo sapiens
cacactgacatctccccaacaggtgagggcagggagagctccagacagggagaggccttcagagaacaggaaggaagctccctccctcctctgcattttgcagcctgtagctcacgtgccttttatgccccacatctcattctgtctggggactccatacgtagtggctgtctaccttcccgcgtggattgtaatgcttttgctaccaggggtcaggccatactcatcactgcaggccctgaagcatccatcatgttcctcgagctcagtatgtgctccgtacatgtagcacagtggaaaaacttgagctttgctggcaaagacagacagaatgagcttgaatctcagcccagctatggcttttctagtcctgtggctagaaaatgacttagcctcttggactttggttaacccatctgcaaaacagggatggcacccacctcttagaaagttacagtggtcaaaaaaaaaaaaaaaaaactcgag

SEQ ID NO: 3355 - DNA, 793 bp, Homo sapiens
ggcacgagattttcttcatgcagtattctcagattggaaacatgcttcatgtttcttataaataaccctcaattatgagggcgtacttttcactttgaagaaaattgacttgcattaaagtggctaacaattctttcctgggcaggatgtaaaattttcctctcctctaataccagtactgttgagctcacattctcccacttttcctcttttcaggtggttcacgtatttgggattttatgaaacctcagaagcagacatgttaacttttcttatctttttattccctgaggtagtcctggggctcttaagagattacagttcttaaaacctggaaagtgacaccagagaggtagatcttagttcccaaaattaaagttactttctagggcataaaaccttttcagaattcagattaaattttatttattttttcttttttctgtaaccttatatttgaggggaaaattttattttcaacttttgcatatatctaatttaacatttgggaaaactgtaaatgggccaaagtttctccctttatatgattttccagatttttaccactttcttagtgccacttgatgctaggcattgtctattggagactcactggtacgtaactgcaggttttaccatggaaccacatatacacatgtcttggaattgagggttagggtttccagaaggacttagttgtcctgtgcttttgtctgccccatgccaaagaccactaagaacagttttgtaagtgaaacttgggtctacacgttaaaaaaaaaaaaaaaaaaaa

SEQ ID NO: 3356 - DNA, 1873 bp, Homo sapiens
  misc_feature (1832)..(1834): n equals a,t,g, or c
  misc_feature (1863)..(1863): n equals a,t,g, or c
cttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtktgggaggaaggaccaggtggggagctggttatccaacagaagcttctggtgcccaaagaatcttatgtgaaactcctgattggtccgaaggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctcannnaaaaaaaaaaaaaaaaaratggggggggnccccgaaccc

SEQ ID NO: 3357 - DNA, 1270 bp, Homo sapiens
gaaaccatccaagataagagacatgggagtgaaattcacacccactctggctttcataccatgggtctgaacattagcccatggtgtttcttggccatactgacctgtgccatttcagctgcattcatctcagttggtgttgtctgctggctgctctttctgatttcccacaggagcagtaagaacctgaggaagagtagggtcagaggagtctgggagaatgaggaaatatgagagccccaggaactgaaaaggcctgtgagagactctgagcttcctgggaacaggtataggttctttttatttcaataataacagaaacaactgtcaaaaccatgtgcctgtactatttggagtgctgtccttgcagaatctcattataagaaccttaggaaataggcacatcatctcctggatagaatcctaggaaatgggcactataatgggcactttatcccattttataaacatggaaattgaggcacagagagattaagtactttcccaaggtcatacagctagtgatggaggagctagcatttgaacccsggagtttttagtctattgagtttaaccgacagatcatactgtgttttggtagggaggragggtgaagcaagcaartgaacaaatgartctgggatttargacttgccagacaaacaaggcccaagaggcaagtgtgcaggtgggtgtagttgggagtcagcagagttgggttggaattcaagctttgccacctgctggctataaaccttggttgggtaagtaacccaaggtaaatgagatcatctctgtaaaactcttagccttgtgcctggcacatagtaaatgcttaataagggttcactgttagtattactgttactgataacatacaaatagattgtattaatggaccataattgcaactgtataaaacaaattccatgtttggccaggcgcagtggctcaagcctgtaatcccatcacttcgggaggccgaggtgggcagatcacgaggtcaggagatcaagaccatcctggctaacacagtgaaaccccatctctactaaaaatacaaaaaaattagccaggcatggtggcgggtgcctgtattcccagctacttgggaggctgaggcaggagaatggcgcgaacccagggggcggagcttgcagtgagctgtaattgtgccactgcactccagcctgggcgacagagcgagactccgtcycaaaaaaaaaaaaaaaaaaactcgagggggggcccgaacccaatcgccctatag

SEQ ID NO: 3358 - DNA, 3430 bp, Homo sapiens
cagacatgcagaaagtacgaatctgctctgagggcggatggaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaattgccatatctccagcaacttggaggaggaagacgatgtcctgtgggaaatcgagagtgagttgccaggaggaggagaaccaccaaaagattgtgacaccgaaagcatggctgagagcaactgaagggaaagggaaagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacaagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttcttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaaaaaaaaaaaaaaaaaaaaaaaa

SEQ ID NO: 3359 - DNA, 1112 bp, Homo sapiens
ggatagcaggggctcagtcatattttttggatgaatgaacaaaccctgaagatgctacatctgactctatatcttcattttatccttttcgtatttcctattacctctaatttctcttccctgcacccatttctatttatttcatcccagtttacctcctgctgccagattaattttcctaatgcacaggctctatcatatcatgagtttctcattgctacatatgactaatttgccaatatttttgcacatcagaatgtgtatcactttgaggctggttctgtgtttgttttagtttaggaaaagctgttcagattgtctgtaaatccgtatggggatctttgcataggattttaaagcagccacacatcttgtacaaaatgtataagattaattttctatgttaggaccatttgttttcaccaattccatagagctccaatgtgtaaaagaagacactgatctaactcttgtgttaaatatttagtaactcatttatctggaagaaagcaaaacaaaacaaaaatacaaggaataaaaatcactgggagtgcttttcattcactgaataatgagttttgcaaggagcacgtggatggtgacattatatcttttacatctttattttctgtttcttttttgactccttatcagtgaatttatcttattttatacttttactttctatttctttcttgactctttgttggtgaattggtagcaagagacttactgtctgatcagaactttgaatcttcctgcctctctttctttgaggttgacagggataaagataattaagatagcgcttgggtgtgatgacactggaagacaggctgggtcagggcctgtagtararacttcccccctctattgaatgttaatctgaaagtgaatctgaaagcagatggtcatgaactacccagggtctccattaagcccatgaagtttattttaaaactcttaaaatagattgagattcaaattgagattcatgtctattttttaaacattgtgtcttaacaaagtagatgttcagtcatacagttaggcaaatgttctaaggaaagatgtttmccatgctaagttaaaaaaaaaaaaaaaaaactcga

SEQ ID NO: 3360 - DNA, 1024 bp, Homo sapiens
ggggcacagttgaagaagcgaccgagggactgggagtcgttagtgaggatgacgcggcatggcaagaactgcaccgcagggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccgsttcgcgggctccggagtgaagctgcaagcggagaaatcacggccggtgatgcaggcctgagtgtgtgcgggagaccaaataaaccggcttgggtgcgcaaaaaaaaaaaaaaaaaaaaaaaaaaaaaaaaaa

SEQ ID NO: 3361 - DNA, 1220 bp, Homo sapiens
  misc_feature (803)..(803): n equals a,t,g, or c
ggagaagtgcctaacatcccatgtgtgctaaggtggcagatcctgagctctccagctgccctcactgtggcctcacggcacaaccagggccagagtcaggaaacatcagtcactcgcttagggaagggagtccgagaaccctcttcgtggactcaacttcccaggcttctgtccctgctgcagaatgcccaggccacagagaagggacccccttttcaggagcttccacgtcacaggcttttatggggcctttcttgcttgtgtttctgtttcccatcctgagggtgtgtggaataatacgagagcctacccaggactggagcgtgttattagaaagagcacgcttgactgctcccgggcagccacctgccctttttcccttggaaagtggacctatggccactgcacaaaacacttcctaataccaggctgctggtgactacattttgtggtttctttgttagttgatatttatagttcagatctcatcactctgccaagtgcaataaacattttgttttaactggaatataacttttattattgttattatttttcttttaaatgtcttaaaagtgaccagcttgtgcaagtggagtcagaaaccctaaatagtctaaatgccaagtcagtgcgctctgtagatcagtgtacgattagaagacaggctctcatttattactgcttgtatttatataatggaagttaggtaacataagcccctctgcaggccagcttagatgttgatgatgcttaaatggtaaaatctgtgagaatgttcaacaatgccctgtatttgtacngcctaaaactgaataatacatatgtgacatgaataaataggtcagtgatttttatgacatattaatttcctttacctaagttcctgggaaatatagctgaacagttacagagaatgaaaacaaacactggcatcttacaaacacctgctttgattatttagtctaattaggttaaatttaactatttccattttaacaaattgaaaacaattcttatctgttcctcggtcatgcactttatcagtgttggatgcagatgtgtttaatatgacacagttggtgctgttttctcagctctgggtgggaaataaaaaggaattgagaacatatttttagagtcttctggggactttgtatttctgggcctatagctatgaaattttaaggaggaggaaaaaaaaaaaaaaaaaactcgta

SEQ ID NO: 3362 - DNA, 1172 bp, Homo sapiens
  misc_feature (1)..(1): n equals a,t,g, or c
nagaagtcctagtggctctctgctggtgctgaggcaggaagggccagaagctggtgagcttccctgaaccctggtgtgcctgggagtcagttccgaagaaggcagctgtcccagagatgtgacaggacctggctgttgtttctctctgaccctaacaggatttatgccctgcatccgcggtgtttttcactgttttattcttattattcttattctcttggcgtcacatgcgtttagtggatctggaaatcaaaggctgaaggaagcgctgacattgatcgtatctgttaattgtggatattgccagacacagggcccttcttggagcgtatacatgttaagaagggcaacacttagcccccaaaacagtaccccagtgttgcgtttacatgcagcagaaatagctggatggagagagattttgagccagggtctgccaatgccacttcagcctcagggctgagctgggcctggagaggaaagctgctgagccaccgttggagcaaatgactgaggacctctgctgcccctacttctgcccgagagctgagctgacctgattgtgctttggcatcaccacccactctggccccaacatctagccttgccaagttcaggtgctagtcatgaccatgtagagctcaccgtgtacccaaagactgtggcagcttcctggctgctggagctttccaggccccctatcttctgtttattcactcagccagcattaactgagcatggactggatagggttgctgcccttgtggaatgcaccatctggagagagagaggaatgtggtatcgcagacgctacagttgctgccagtttagggatagaagtatcagggatgtcttcccagaagcagtgatgctccaacaacatctcaggcacttggctgtggccacatatcggctgcagaaggagaagcccatgcaaggcacccacagttgaggaagcagagggtggcaagccacgagcagtgccctcaggcacaggattccagaagcatgggcaagagcctggagggtccacatccccacattggttctggggacatttgcaactccttgtcttgagtgtcaacaacaggcagctctttgttcagggcagggcagggtatttggagatgactggtttgccctgtccaaagctgctgctcacactgttgaga

SEQ ID NO: 3363 - DNA, 1667 bp, Homo sapiens
gagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtaaaaaaaaaaaaaaaaaaaa

SEQ ID NO: 3364 - DNA, 2059 bp, Homo sapiens
ggcacgagcctcactgggtaaacacaagctctcggcagggaacaagctctcggcagggaatgcacagagaagcactaagtcaaagtcatctccgtgtggtcattaaaattccagtgaatgaaaaagttttagggaacattaactgttaatggcttatgtattagctgttctctgttttaaaagcctttgggcacttttcaaacctaacaaacaactgattgaatttctattgatggtcaaagtggtaaaaatacctctttgttatctaagacaacttttaggtggcattaagaccccgagggtctaggggcctccaggtgtacggctttgaagtaagggcaagaagcatgggtgccctctaggagcactgggagggacagtggaggaagaggccccgcccgggtgccactgctgaggcagctcttagggccctgccacttactttgctcagagcaaaaggtgccgtcagctgggtcctacccccgcctgtgcggctggatctgggctgcgtcagcaccgggacccgccccagcagcacatctgtcaaagcggaaaacagttcacacaccagagcctcatgtggaaagagtccaggcgctcagacttttctccttcatgaccctcatctctgctctcgggcctcagcccgcctgtcgtactgcaggaaattttgtttcctgcttgtcttcaaagacttcagggcttagaacggaccatagaaagatatgaaccgagagccgtggcagctgtccagcttgcaggctgatatttgtgtagatgccatgcagataacacagcagggtccaggcccttccctctggaactcacactcggctgtattttgggaggaaccgctgggcaggttctgcccaggaacagttaactctgcagagcacagtttccacatctgggctgagttcccaaagaaagtgcgcctaacaacgtcttgtggaaggcggttggcgtcaagagaagtaaagtgttcagatggcagtgattttaatgaacctactagctattttaataggaaagatttttttttttatccgtttggtttttatttttagaatcatgaaatagcaagttggctctgctgaagtagaaatggtgggcggggagtcgccactgaccatcgtctgcgcagagcaccttcctgctgaccacagctgtgagcgccggctgtacgcaggtccctgctgtgcgggtgcccaagagggctgagggctgcgtctgccatggtgtctccaccttggacaccatgaatcatgagaggttctcagggctgcctcccacaggctttctgtgtcttacctgggacactcgggactagttgtgtttaggttttcttaaaattctgtagtaattgcattgtagagcatccctaatccgaacttcagaaatccaaaatgctccagtgagtatttcatttgagcatcatgtcagtgctcagatatggtcagaccctggagcactttgcattctgaagtgaaggatgctcagcctgcgtctgacagaagctccagagaagtggctgcgagttcagggcaagaggctcctggctttgaggctgcaccgtttctggaagtcaagccccacagtggacctcgagtccctctgtgaataggaatgtgctcgggcagggaacccggagcaccagccgctgggcccctcgttccccggctctgcagcgtctttcgggtcctgtgggtctggctgtgcccagccctgctgcccgtggactatagtgtcttggggtcctgcaggcttggctgtacccggccccagtgcatggtggcaagtgcctgtgatcccagctactcaggaggctgaggcaggagaatcacttgaacctgggaggcagaggttgcagtgagcggagattgcgccatttcactccagcctgggcagcaagagcgagactttgtctcaaaaaaaaaggaacgtgcctcattcagtggttcgatggtggttctgatcaatgcccagaagttctgatggagcttctgtcagacacaggctgagtatccttcaccccaaaattaaaaaaaaaaaaaaaaaa

SEQ ID NO: 3365 - DNA, 1174 bp, Homo sapiens
  misc_feature (1151)..(1151): n equals a,t,g, or c
  misc_feature (1160)..(1160): n equals a,t,g, or c
gagaggttcaggttggtcttgctggcatcttcacctaaaatagggtctggcagacaggcccatgcgctgcatcctgcccacggcctgatagatggcctgtgaatggcttttttacattttaaaagtggttgaaaacaaattaaaaatatatttcatgacatgaaaatcatgaaattcacatttcattatctgagaataaacttttatggatgcagccatgcctgtctgtccatgtcttatctgtgtctgctttgtgctacggctgcagagtggagtggctgggactgagacggaacgccctcctcacggggccgcgtctctccaccaggaccgcggggctactctgaggctctgcttcttccccagcggggttggcttcctgctattcctcagtatcctgccttggtcctgagttggtccctctgscaagagccgtttctgtgtctcagtggatggcgcactgsccttcttgttggtaccttgactgatagackggttcctgttcackgcyccgaagtcatcccagaaaacctctyacagttgcatgggttgaacccagtccgcgtgtatttagagttttgtctcttgccccttcacccagaacagcagcacccaccaccttcctgtcccctgtgactgcctcgcaactgggtctgttctgtgagatgtcgccaccctgtttgccatctgggaggatctcactccttcaatttaatctgctctcttccgttatttttttagtttctatgtattttacttttaggacattccagcctgggtgacagagtgacggtctcaaaaaaaaaaaaaaaaaaaaaagcacaccagtgtcttccatttctcttttaatcataatcatgctttaaaaaataccctcgagcatatggagcaaatttaagataattgttccttttctgctaattcattattactgtcatatctaggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactragtctgtgtagtaaatttttgactaggaaaaaaaaaaaaaaaaaactnggggggggnccccgtaacccatt

SEQ ID NO: 3366 - DNA, 2271 bp, Homo sapiens
cggcacgagcggcacgagtatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgatacaaaaaaaaaaaaaaaaaactcgagggggggcccggtacccaattcgccctatagtgagtcgtattaca

SEQ ID NO: 3367 - DNA, 1144 bp, Homo sapiens
  misc_feature (849)..(849): n equals a,t,g, or c
  misc_feature (865)..(865): n equals a,t,g, or c
  misc_feature (1087)..(1087): n equals a,t,g, or c
aattcggcacgagggacagtcagctaactaggcaagtcacaatcttatatagcataatcatggaagtaacactccatcatctttgctgtgttctattggttagaagcaagtcactaggctagcccatactactgggagaggattacacaagaacatgtgggtagaaatgggaataacttcagctgtccaacaatcttacaggtatatccttcatcaatcattagctataagtaatattgggtttccattagtcaaagatctgtgtgtcagcaagccaggacttcaatattttttaaagatggtctttctagagaaaaatacagtaataatgggatgacagaaggccatgtgttttgttttgctttgtgttgtgtcttggttttcctctctatgactttgcttgttaycagcttagaaaaaactaacgcaggtggggtgatagcatggggctgtatctcagtctctgtgcagacacaaactttttcctctcctaccagttaccaaacattgtttattgcctgtaagctctggaatcccagaaaactttagttttaatctttatcatcatcattatcacataatttacatcctagtttagatttggagcttgttttagattaatackttacagagtagttttacatgaataagcttaaacattttcccccgattttagttctctggcttaccagaaaaatgaaaaacaacaacaacaaaatccccaaaactgagaacccaggaatgatagacaacaaacttgtgttttaattttcatgattctagttgttcaacctgtttttttgacactctgtatctgcattcatttattcactaaaaagatgcttagtnaattgtaagtatcatnttaggcactgtgaattcattgataagatattctctctctctctctttttttcttttgagatggagtctctgtctgttgcccaggctggagtacagtggcatgatctcgtcggctcactgcagcctctgcctcccgggttcaatccattctcctgcctcagctactccagcggctgaggcagaagaattgcttgaacctgggcagcggaggttgcagtgagcnaagattacgccactgcactccagtctttctcaaaaaaaaaaaaaaaaaaaactcgag

SEQ ID NO: 3368 - DNA, 798 bp, Homo sapiens
gaattcggcacgagcaggagttcaagaccagcctgggcaacaacagtgcgaccctgtctctttaaaaaataaaaataaaaatggtaagaaaaaaactccaaattacctcgatactcagtggattaaaactatttctcttgattttgtggattgactggttggtttttgccaatcttgcgctcatacagcttcatctggtgggtcgggtggggactggacttgagtaggatggctgggtctccttccatgtagtcgctcgtcttaggcttcttcacagcatggtagtcttaggacaggagtarcagctgtaaggcccttggggctgtgggttagaaattataccacgtggattctcgtgttcaaagcaagtcacaagtccagttcttattcaaagttttgggtaaataggctatatctcttgattggaggtgctgtagagattctctggccgtatttaattttcaacatcagtatagttagatgaatgctgtggtgtagatgagcaaagggtgctatagaacagaggatggaaacctaattcagcttgagggaagggtcaaggaaggcttcttggagttggtaatgctttacgtaagccctttaaataaaagtattatgtgatggtgtggttatagaaaacataaaggtatggccgggcgtgatggctcacacctgtaatcccagcacttggggaggccaaagtgggaggattggttgagctcaggagttgagaccagcctaggcaatatagtgagagcctatctctttatatattaaaaaaaaaaaaaaaaactcgta

SEQ ID NO: 3369 - DNA, 1588 bp, Homo sapiens
  misc_feature (778)..(778): n equals a,t,g, or c
  misc_feature (1150)..(1150): n equals a,t,g, or c
gggaacgttttcccagctgaaccacatgtgacgaaccaacccatttatagtctaaaaattatgagaacaagtctcttttttttcttttttaaaaacatcttggtactttgtggtacattgctcatctccagaagttcccattcccagagtgccccgcgaggctgttggtggccacataagtgaccacagcaggccctggaatgcaagctcttttccccgtggctttggagcagaggggagtcagctgggtggccttgtctcctgaggggcattggccagggtcacactcggttttctagggaccaggctgttccatggggtggagaggcagtaggccatccctttctcttcatcttttatctagcccttccccatacaaacactttctcacagaaagacttgtttgttgtcccctgagcaaggccacagctctcccacctatcttctgttcaggttggcagatgggttcaggcaagggtcattctgagaggagacctccacccaatgctcccgtctgctggcttggtcaccctgagctgctgcctgaggggccaggaaagtggctggtgtccccggcctgtgagagatggccagagcctcagccagacccaccctgccaggagaaaaggggagtggccggagaagccaccccttgagagcaggctgggctcgcccttgtgcccaggagggctgcacaggtgcagttgccactttcagaccacacacttcaagctagagcttggcctgtgcccctggtggttgggggttggaagarcanactgtgttgacagggtctktaattcmcgattccaggtgcttctgawttgttggatcctgatgaatcgcaatcaggactatgtttggcttgagctccagcctcatgaccaccaaccccatcgaatgactgagagctgccaggctcctgccacgttggagctcasaatcctcccgtggggacactgtgctgcagccagcctccagggagccgcttgttttatggcctaaaaagtctctttatgctgagaaggtcacactggactttgctcacacagagatttgacccaagaaaaggaataaagakgccttggataccctgtcttgcccctgttcctgcccccgccgtaccctgctggctcatgscagaagamtnggaacttgctgtctgtgggcatgtttgttgtcggctgamggtagcacccacagcactggccgtgtgtgtgccacagtcaggaacgargtcctgccccccacccattaacccattagctttgtccttactccttgaggccctgcttgaaaagattaatggtgctttgggargctgaggcaggaggattgcttgaggccgggagctcgagaccagcctgggcgacatagcaagaccctgtacctccaaaaaataaaatataaacattagtcaggcatagaggcacacacacacataggcctagctactcagctgaggtaggaggattgcttgagcccaggagttcaaggttacagtgagctatagtcatgccatcatacactcagcctgggtgacagagtgagtccttgtctctggaaaaaaaaaaaaaaaaaactcgag

SEQ ID NO: 3370 - DNA, 1471 bp, Homo sapiens
cctcctctcccctccctccccccgctaccctaactttgccaggcaccttttcccttccatccatcttaaaggaaggaagggacgggctgagttccccgacgagagacacacccagattttcctgcagcttggggagaggtcctcccaggagccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgaggtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccaaaaaaaaaaaaaaaaaaactcgaggggggcccgtacccaaatcgccggtatgatcgtaaacaatc

SEQ ID NO: 3371 - DNA, 1363 bp, Homo sapiens
gcatgcactggctctgtgtctcctgcatcttcacttgtctgcctggctggcggccagcggcaccagaccaaggacccgccgctatttccctgtgttcactgccttcctcttcgcaaggacaccgagagcccctggctctgggcctcccatctgcccttcctcccgcccatcgtcagcgtttacgagggtctgccacgtgccaggcgcaggggaaacagcgcagggtcggaggcagaacccgcctactggggagacaggagtggggagtggcctcacaccccacaggaggggatggaggaggtatgcctggggccatgccagagcaaggcagaggcttggtccagcctgtggcagtgagcagccggtgggacagaggccacagcaaggccaaaggtgtggggagggcggggggtgtctctctggtcctggcagagctgccagtccctactacgtctgtttgttgattgggtcatgtttaacttcgggaaccatgcacagtgttggccacgagatgccgtaaccagaataaaacaggactctggcgtcaacgtagctgtctcatgtcctgtcaggaggtagggcagagataaggggctggtgtgattaacgccagctgcctctgccctggtggagaggacggaggacatcacgtccctccagccaccccagcctgtgacacgtgacatttaaagattttycttgctctttgaggcacatttttctattttcaaggacagatgaggtcacagacgcagtgtgtgctgcatttgaaatgttttaggctaatttttggcctttgattccaaagcctctttaagacrtatgttctctctgtcatcacccgtgtggcccagcgaaatcctgaactctaaggagaaggcaaatctctctccttgcttttcagcctcagacagtgaagtgagaagttcaacatgctgggctttgtagctgttttctccttgttttctagacgtgtccatattctagagtttcttatcttgggaagttacatgctctgtttttgccttttttttttttctttttttgaggcagggtctcgctctgtagcccaggctggagtgcaatggtgtgatctcggctcactgcaacctccacctcccaggcccatgcaattctcaagcctcagcctcctgagtatctgggattacaggctcccaccatgacgcccagctaattcttatatttttagtagagacagggtttcaccatgttggccaggctggtctcgaactcctgacctcaaatgatccgcccacctcagcttcccaaacaggcatgagccactgcacccggcccattgttgcctatttaacgattacaaaaaaaaaaaaaaaaaactcga

SEQ ID NO: 3372 - DNA, 1046 bp, Homo sapiens
ggcacgagtttctctgcttcaggagtgcccgccggcccttgcagctgctggaagacccatgtatctcatgcttcttgttttctttggggacctgcaggggaaggaagcagggtgacggtttggtatccccacctaagaccctcccctttcccctgaggccagccgtcagcccctggcagggggtcttggaagccagaggtttttgctcagggcagggaaagggctgcaggatccccgggggctgccggaggtcggtctcactgacatcatggctgaccccagcatcgcctggtcccacagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatggtggcaagtgcaggcagctgtcccggttatgccggaatcattgcaggtgagtccatcagaaacaggagctgacaacccgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgcaaaaaaaaaaaaaaaaaa

SEQ ID NO: 3373 - DNA, 2031 bp, Homo sapiens
ggcacgagcttggcctcgcaaagtgctgggagtataggcatgagccaccactcctggccaggacagcatattttggaaattcacctatgttgcatgtgtcaatagttaattcctttgtattcctgagtagtattccattttgtggaaatactacgatttatgtacgggttgagtatctgttatctgaaatgcttggggccagaagtattttggactttttttttattttggaatacttctatttgcattttaccggttgaacatcccaaatctgaaatatccaaaatccaaaatgttccagtgagcctgaattcatctgttgatgggcatttgagttatttccggtttgaggctattatgagggaagctgctgtacatgtgtttgtatatgttaaatgtgttttcacttgtcagattttaaaagatttaacagatttttaaagtgaaaattgttttaatgatggtatgcttatttagactattaggaatttaaaaaattatcatttaagattcattccaggtcctgcattgattttattgggtcacaataatagtgtccatttgaagatatttcaattttttcagcaccgtcaatttcacttctagctgctatcagtataccttctgtaatatctagcttctgatttctcctttcatgagttagaaagcaggagaattgtgattatggattaatgagtcccttaatttgaggtcttaagataaatggaatttaagacttaggccaactgctattttgtagctctaagacacatttttgcttctgatttctatgaacatatcttatatgttgaacttcaaatatctcttacaagaataggaagcacaatggtgtatttgatcattgtgatcagtaaatacacaggatgtagcttctagatggtagcccattaaattatagtatttaaaattattatcaacttttatcttgctgaattttctgtgttaggtttttcttaatttcttattatatattacttagagtggattataaattgtcttgtggcttattctagtcacaggagtttgggggaaggctctacacaatacttcctaaaaagaaaaagaaaaagtaatagaggagttcagaagcagagacagattactcttggctggtaagtagcatgagtgataaatttaagctgaatgattatggagcccaaatgaaataacttgtgtgaaatgttcttaaaataatatggtgttatataaatgtaactgatgttttaccaaacaaaatggagcagggtgctttgggtgaaagaaggggggcctgttttgatctgctgatggcataattattataatgtattaaagaatgtctcagaactgtagttgtcctaatagtactgcttgaaactttcaaattgttactgctttcagttgctttccgaagtggggataatggtggatctgatctcttctgttttgttcttgcagctctattatcaagtcctaaattttggaatgattgtctcatcggcactaatgatctggaaggggttaatggtaataactggaagtgaaagtccgattgtagtggtgctcaggtaacagtttttcctttcaaggcatggaattgcatggcattacttgggagaaaaattgagatatgaaataactggcatatcattctcttagaaactactcttttccagaaaagggcctggaagaaaattagtcactacttatcagttgtaagaaattctcaggctgggcacggtggcttatgcctgtaatcccaccaatttgggatgctgaggccggtggattacttgagctatggaatttgagactagcttgggcaacgtggtgaaaccctgtctccacaaaaaatacaaaaattagcgggtgtggtggcatggacctgtagtctcagctactcgggaggctgaggtgggaggatcacctaagccctagaggttgaggcctgcagtgagttgtgattgcaccactgcacttcagcctgggtgacagagcgagaccctgtctccaaaaaaaaaaaaaaaaaaa

SEQ ID NO: 3374 - DNA, 2275 bp, Homo sapiens
  misc_feature (1449)..(1449): n equals a,t,g, or c
ggcacgagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcastttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagaaatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagntttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttaggataccacccctgccctgccctgccccaaaaagaaaaatgtttattgtcctgctwaatctatatgcctacacctcaggaaggctggacmggatgaggcttccymaaaacatg

SEQ ID NO: 3375 - DNA, 1709 bp, Homo sapiens
ctaaagggaacaaaagctggagctcgcgcgcctgcaggtcgacactagtggatccaaagaattcggcacgagaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttacaatctataggtacctttgaaaggtcataaagggtaaaagtctatagttttccagaaaataattcttaaaactgggttttatgtctagatttaaatcatgtatctgtctgtagtgcttcaaatgtggccaggtgtggtagctcacacctgtaattcccagcgctttgggaatttgaggcaagaggattgctagaggccaggattttgagaccagcttcggcaatacggtgagaccttgtctctaccaaaaaaaaaaaaaaaaaaaactcgag

SEQ ID NO: 3376 - DNA, 1797 bp, Homo sapiens
cacacactaaaatattcatgaggaaagggagttgctgattttaaggcgtagctttaaaacccacgtctgtcggcttgatggtcagtgtcccgccacacagtctggaagtgtgacgtggccaaggaggacccccagaaggatcctgtgtcttccgtggggactactcctttcctcagaggagcgggttcacaggaaactggagcagaaggatgcctttagccccactcctgttggtcctcagtcccttctcctttgatcaggtggttcaagcacgccttgaagttccggtgttcaaacaacgtgacctctgcaattacgttctaatacttgtcggtgcccaacttaaaccactagcaatgttagttaaaaacatcagggattacaggcttgagccaccatgcccggcctgtatagacactttctatcccacttttaaaacaggcatgttctccctatgctttaaaatgcctttaaaatatttctaatggtgctaattctctaatttgggagtgtctaatttgcttccagtttttaaaaactattttttattatagtaattaaccttttaaatacatgaatcttgggcatatttttaatgatttccttaggagagattccttacagtgaatttcttgagtaaaaggaggttaactgtaagattcttgatataccttgctaaattgtcttctagaaagcttgaaccaagttctgcacattttagcaaagtatgaaatgtccttctctccatatcttcatcagcattgagtgttctctcttttttatctttagacaaaaaggttacattctttttggttcatctactcagaagctatttaatgaatgttcactccatgtcaggcatgtggcatgttttcatctctaccagtaacgctgaactttcttcttgtgtgcatcagcctgttgttttcttttgtaaatgttctgttcgtgtccattatcaacttttctactagggtgtgactgtttctatgatatatttataacgatgtgtgtgtgtgtgtgtgtgtatacgatatttggggtaaatacttttcccagcttctttgacttttaattttgcttatactttattggaaatacagaacctttattttattattattattatactttaagttctgggatacatgggcagaacgtgcaggtttgttacataggtataaacgtgccatggtggtttgctgcacccatcaaaccaccatctacattaggtatttctcctaatgctatccctcccatagtccgccacccaccaacaggccctggtgtgtgatgttctgctccctgtgtccatgtgttctcatgagaacctttatattttatgtagtggagtaagttattttatctttttttttttcctgtgtaacttctgttacctcaggcttaggaattccttcctacccagaagttagaaaatattcatctatttttttttaaagtttcatttttaacattaaactcaccaaattagaagtaagatgtggccaggcacagtggctcacacctgtaatctcagtgctttgcgggggctaaggtggaaaaatcacttgaggctaggagttcaagacaagcctgggtaacacagtgagaccccacctctaccaaaaaatttaaaaattaggcaggcatggtagcatgtgtctgtagtcctagctgcttgggaggctgaggtgggaggatcacttcagcccagaagcttgaggctgtagttagctattatcatgctattgcattccagcctaggcaacagagcaagaaccctgtgtctttaaaaaa

SEQ ID NO: 3377 - DNA, 2321 bp, Homo sapiens
cgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacacgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaaggtaagacggtgtgtgctgcccgcggcccggcccccgtctcctgtgctgcccacagctgacctgggcctgtctctcctgtttcagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcactccgcatggactctgggatcaaaggctctttcctcttttgtttgagagttggttgttttaaagcttaatgtatgtttctattttaaaataaatttttctggctgtggcatttttcttgacctggtataatgaaagtatttcagatatttgaggtttaacccttttccagaaagtaatacatgatatggatttatttatgcattaaaagagcaaatttaaagaaaaaaaaaaaaaaaaaa

SEQ ID NO: 3378 - DNA, 1139 bp, Homo sapiens
ggtgacgctagagcaccaaggggggctctacagctgtgttctcatggaggacaggcttctgctcattctggttttcccactcttgtggttcccagttgcagttttccagttagttttattacttccttttcttttgatccattccctaaactgccttgagtggaggcatttgtttagtgcttatcgtgtgcatatccttgcctggctagcatacccatgtttctgtgtctctctccgtgtgaggcattgtattgagctatttatacagattgttttatccttaccacaatgctgtgggataggtggtgtccccattttataggtgagaaaacagacctagagaaaacaacttgttcagtgacacttcgtgtatgtcttttcctgaaccctgtgctgaattttccaaggagcctagttactacattgtctaaaactaagaaagagcagacataatgtaggcccttcggcccccttcctttttggttaactgagttatgccaatttcagcagtatgctgactgtacacttcattgtattttagagaaatctgtttcgctgtgaatgcataaaggctaaggagggaggaacaacccttgtttgctgctgcatctcttgggacttgggcaaattcaactttgcacgtggcagatctcttgggaaagccacttgggttttaaagggaaatattttaaaggtaattccaaggttgttaagtaatttttgttcacatggttgagttttcttcactgtgggactgagactgccgcagattacgttactgtcagttcctcactttttccacttggcaagaaaaaaaaaaagattcggcctggtgtggtgctcacgcctataatcctagcactttgggaggccgatgcgggcagatcacctgaggttggagttggagaccagcttggctaacatagtgaaagcccgtttctactaaaaatacaaaaaattagccgggcgtggtgatgcgtgcctgtaatcccagctacttgggaggctgaggcaggagaatcgcttgaccctgggaggtggaggttgcagtgagctgagattgcgccattgcactccagcttgggcaacaagagcgaaactccgtctccaaaaaacaaaaaaaaaaaaaaaaaactcga

SEQ ID NO: 3379 - DNA, 1476 bp, Homo sapiens
ggcacgagcatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagaccgaccgacagttccaggagctcaacgagctggctgagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcgtggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctccttcccgtgtcttgtatttgttgggcctgggctactgctcaccctggttaggtgagcctctaggaaaacttaaaacaaattttaagccaggtatggtggcacatacctgtggtctcagctattcaggaggccaaggcaggaggatctcttgagcccaggagtttgagaccccatctcaaacaaaaaatacaaaaattagccagccacggcgcctgcacttccagcttctttgagagactgaggcaggaagattgcctaagcccaggaggccaagtctgcagtaagctatggtaacaccactgcactccaacctgggcaacagagggagactctgtctctaaaaaaatagaaaaatttgccctgcatggtggctcacgcctgtaatcctagccccttggaaggccaaggcgggcagatcacttgaggtcgggagttcgagaccagcctgaccaacatggagaaaccccatctgtactaaaaatacaaaattagctgggtttggtggcgcatgcttgtaatcccagctactcgggaggctgaggcaggagaatcgcttgaacccaggaggcggaggttgcagtgagctgagatcgcgccattgcactccagcctgggcaacaacagtgaaactccgtctcaaaaaaaaaaaaaaaaaaaa

SEQ ID NO: 3380 - DNA, 2331 bp, Homo sapiens
  misc_feature (3)..(3): n equals a,t,g, or c
ggnatgaacaaagggrwatgsamakctcctataggkaaagctggtacgcctgcaggtaccggtccggaattcccgggtcgacccacgcgtccgcttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaagggcggccgctctagaggatccaagcttacgtacgcgtgcatgcgacgtcatagctcttctatagtgt

SEQ ID NO: 3381 - DNA, 1915 bp, Homo sapiens
ccacgcgtccggaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacacgaaaaaaaaaaaaaaaaaaaaa

SEQ ID NO: 3382 - DNA, 2112 bp, Homo sapiens
aaccccagttcaatacgactcactatagggaaagctggtacgcctgcaggtaccggtccggaattcccgggtcgacccacgcgtccgggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtgrtgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttargtgtgaagatatgtgkctattgcagatgtccttggaaaactgcataaaacagtatgtgccyggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttytccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttcaaattatctttgtagataagaacagtgkttcttttttcttttcttttgkttttttgkttgkttgktttgktttgttttgagacagagtttcactctt

SEQ ID NO: 3383 - DNA, 1067 bp, Homo sapiens
ggcagagaatagttatgcacaaaaataatttatttttgtgtgtattattcaggttattattcaggtgttcgtgttttaatttgttaaacttcccacaaacatatgctgttggaaagggccaggcagggaaagatcagtgctcaagctaaaagaatgaawgcttaatgtggacttttaggcactaatacctggatagaagaggtatttggaggcagagatgttttcttggtgttcctcaaaccacrgcatacaagtaacccttataacactccctaatctagcaataaattgtgcctagacatgaatcctcctctgacttgaagaactactgctctgggaaggaactaaataatccaaatcttagcactkgatcatacagcccatatggagttctttatacgatgactgcttcattgtataaatcctctctccccactcaagccttaaactcttcgagcgcagaaattttattkgtcctcattgtacaccaaacaatgttaaatactcagtaaatacctggcagactgaattgaggcagtacggcttataggaaaawtctacctgaacacacatgagactcaaawtacttcttgaatttacatcatgaccaaccatccacttttactgcaaagagaacttttcatacagattatttccaaaacccaatggttcccagtcatcacagcttgtccctgacccagttctccttctcaacctgattgcaatctaactccctcctcccttccctcgtcttttcaagatgcaccacgctggtgcatcttgaaccgtgccaggaacggtacctcatctttccccttaaaatatttttcatttgcaactgcattaataaagacgacaggcagcctctggagagaaytctgaatacctgcccgacccacctcagggagtgccactcggcgtaccgagcctcacaggagaaatgtggcccagcccaagccgcccatgttcctcagagttgggaaggaggaagacatttctacgtgaaagtttgattgctttaagggacaaaacccaaaatttgcaatcgttttcaaaacaaactcgag

SEQ ID NO: 3384 - DNA, 2873 bp, Homo sapiens
ccacgcgtccgggatgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatgaacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaaaaaaaaaaaaaaaaaaaaaaaaaaaaaaaaaaaaaaaaaaa

SEQ ID NO: 3385 - DNA, 1276 bp, Homo sapiens
  misc_feature (20)..(20): n equals a,t,g, or c
  misc_feature (70)..(70): n equals a,t,g, or c
  misc_feature (81)..(81): n equals a,t,g, or c
ctcacgcgtccgggacggcnggacgcgtgggtgcatttgctgagtgttttacttccaattatgtgattcnatattacaggngctgccatgtggtaatgagaagaatgtatattctgttgttttggggtggartgttccatagatgtctatcargtctgtttgatccagarctgarttcargtcctggtatctcartctttactgtgartcttcaaatgacataagaatgacagaamttgtagttaaggacaacagrgcawtscaaggcagcagcatagtccaaaatagacgtgtcttcttcccgaagtcactgtagtgggggacataaaatttaaggaacctctgggtcttactacctgatgtggccaattggactaaaaccaataaccattaaggaawaaatssactwaaccacaagcaactcaattaamaaataggcaaagaacttgaagaggcattttcccaaagaagccaacaagcatgtgaaaagatgctcaacatcattagacatcagggaaatacagatcaaaatcaaaatgagataccagtttatactaaggtggctataataaacatcataataatgaaggacattaacatgtattagtgaggatgtggagaaatggaacccatttctggtaggaatgtaaaatagtgcagccactgtggaaaacagtttggtggttccccagaaagctaagcatagagttaccagagaacctagcaatttaacttataggtacatacttcaaaggaattgaaaacatagatyctaacagatactkgtacagcaatatycatkgtggcwttattcacgatagccaaaaggtaaaacaactcaagtgtccatcaaaatataaatgtgtaaacaatgtggtatattcctagaggggaatattattcagctttaaaaaggaatgaagtactggtacatgctacaaaggtggatgagcctcagaaacatgctgagtgaaagaagccaatgataaaagaccatatattgtatgattccattatatgaaatktccagracattcaagtctatagagacagaaagtagattagtgaytgcttagggctggcagggataaggggktcatggctaaagggtatgggtttttgtttgtggaggtgaaaaattttaaaacttgkgstgatggttgcacaagcctgtgaagatactgaaaaccattgaattgtgtgctttaaatggatgaattgtatggtgtttgaactatatcccaataaagctgttttttaaaaaagaaaaaaaaaa

SEQ ID NO: 3386 - DNA, 2596 bp, Homo sapiens
ccacgcgtccgacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtgttatgagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactagatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgtttacttttttaacatgtgttaaacagagaaagggtccatgaaggaaagtgtatgagttgcatttgaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcttgtgatctgtgtacaattttagtcactaagactttcctccaagaactaagccaacttgatgtgaaaagcacagctgtatataatggtgatgtcataataaagttgttttatcttttaagtaaaaaaaaaaaaaaaaa

SEQ ID NO: 3387 - DNA, 1032 bp, Homo sapiens
ggtcgacccacgcgtccgaaaacgccttatgatgaatctaagttctatattggctgtgatctttgtactaactggtatcatggagaatgtgttggcatcacagaaaaggaggctaagaaaatggatgtgtacatctgtaatgattgtaaacgggcacaagagggcagcagtgaggaattgtactgtatctgcagaacaccttatgatgagtcacaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaaaaaaaaaaaaaaaaaaaaaaaaaaaaaaaaaaaaagggcggcc

SEQ ID NO: 3388 - DNA, 1334 bp, Homo sapiens
ccacgcgtccgctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtgacagccccaggtggccaggcctccaggaggcaccaggcaggccctgtatcaggctaggacgctctgagctgtgcatgtacatatatacatatatagatacatttataatatatacacacagtctatatatttatatacactgtttcctggccccagagctcatttgggttcaggcgcacttcaaaaccctccctgggggaggctgtttcttctcaggattccttgccagggaggaaggggagggaacagggtgggttttctcactgaagagagaaagcagaaggttctagatcctggcacagactgcatcccatgttcccatgctcttctccgtccccaggaatgcgaacggcagtttcccttccccagtggacgtctaggtggggacagggtatcttggctcccagctggaccagagtgccctgcttgcctctgctctccctttgtggggactcaggcagcagaggcatctgggaagtctctgagtaggcagggtcctcctgggaggcacccccacctgtttgaaaggtctggccaggcgtggtggttcaggcctgtaattccagcactttgggaggccgaggagggaggatcacctgaggtcaggagtttgagaccagcctggccaacatgatgaaatgttgtctctactgaaaatgcaaaaattagccaggtatagtggcaggaacctgtaatcccagctacaggggaggctgaggcaggagaatcgcttgaacccgggaggtgtaggttgcagtgagccgagattgcaccactgcactccagcctgggcgacagagcgagactctgtctcgaaaaaaaaaaaggtccgtgccaagctgctccctgcccttgccctttccctttccctggggtccaaaccacatgtgtcctgcctctcctggccctaccacattctggtgctgtcctcactcgcccctggcccagaggctcctgaagatgctgggcggtcctggcacagggaggagcagctctgtaaatctgtgcacatggccactcttggcctaataaaggaggtctcacagtcaaaaaaaaaaaaaaaaaaaaaaaaaaaaaaaaaaaaaaaaaaaaaaaaaaaaaaa

SEQ ID NO: 3389 - DNA, 1926 bp, Homo sapiens
taaccatgttcttaacatctagatgcagaaatggatttgaatgtgatctgcagtttctgtcgtagttatgaaatggcttttgtcaacatgggttaccccaaagcaaacattgcatgctatggaaatacttcttgtctctttttctcccatggtatctgtattgcttctttaataataacatcatgttttacagcctgcactctgtgcccatgtttattcaaccctttttactttggtgactgtttatcagatgtgttgccttgttcttcctgccctccagagcccatgtttttaattataactgaaatatgaaatgataatatttgggctttatttcttttctttaaaggacagtactgctttaaagagacagtgttaaggatcttggaagcacagccaacatgtgtgtgacatggaagaagccactaaccaactcctagatgtgaacctacatgagaaccagaagtctgttcaagtgacagaaagcgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggtttgaatggagcaatacttaaaatagttttctaagttgatcattttatggttacttttcattttatagacccttctggaatcctttctgattttcattgctctgccccaaatcaggtgattttaaagttactgcattttctattgagtactgatttgtaattttgactgtagtttcagtatcccttaggaccaaaagtgtttcagatttttggaggggggtggggggagttttggaatatttgcattatacttgccagttgagcatttcttttttttttctttttctttgagacagagtcttgctctgtcatcaggctggagtgcaatggcgcgatcttggctcactgcaacctccgcctcccaggttcaagcaattctcctgcctcagcctccccagtagctgggactacaggcgcccgccaccgcatctggctaatttttgtatatttagtagaaacggggtttcaccatcctggccaggctggtctcgaactcctaaccccgtgatccacccgcctcgacctcccaaagtgctgggattacaggcctgagccactgcgctcggcctgccagttgagcatttctaatctgaaaatccgaaatgctgcactgagcatttcctttcagcattgtgttggggctcaaaaagtttcagatttttagatgtgggctgctcaacctgtagtaggattgctacatttttagaggtgatctagtatttcttgaggattgaattcaccagaaagaatactgttcaacttaagaaattctctaagtatctcagtatttatttacttcagcatatagcagatgtttaacctttggtgatgaaacataaaagagattttccttttaatttgcatcaaaaattcttgctcagaagtaattaggactcactcaaggtaaaaagtgaaggtcagaaaactgcaatctcactatcataaagctgatatatctcattaccacataagcagtgagagggcaaggattgttgtctatttttttttccaccaatatatcccacgctcttagtgtctggcatatagtaggtacccagaaaatatctgtgggatgaattggtaagcaaatgttttccatccaatattttagccaataccctcagcagctttgtgaagataggcactattattatcctcattaatcattaggcttaggacacataaataatttccccagggccactcagctagtaatcacagaactggagctcaaatcccctgcaaaaaaaaaaaaaaaaaaaaaaaaaaa

SEQ ID NO: 3390 - DNA, 822 bp, Homo sapiens
  misc_feature (813)..(813): n equals a,t,g, or c
  misc_feature (817)..(817): n equals a,t,g, or c
  misc_feature (822)..(822): n equals a,t,g, or c
tcgatccacgcgtccgcggacgcgtggrgttgaaaattcatagtaagattgatatctataaaatagatataaatttttaagagaaagaatttagtattatcaaagggataaagaaaaaaatactatttaagatgtgaaaattacagtccaaaatactgttctttccaggctatgtataaaatacatagtgaaaattgtttagtgatattacatttatttatccagaaaactgtgatttcaggagaacctaacatgctggtgaatattttcaactttttccctcactaattggtacttttaaaaacataacataaattttttgaagtctttaataaatamcccataattgaagtgtataatataaaaaattttaaaaatctaagcagcttattgtttctctgaaagtgtgtgtagttttactttcctaaggaattaccaagaatatcctttaaaatttaaaaggatggcaagttgcatcagaaagctttattttgagatgtaaaaagattcccaaacgtggttacattagccattcatgtatgtcagaagtgcagaattggggcacttaatggtcaccttgtaacagttttgtgtaactcccagtgatgctgtacacatatttgaagggtctttctcaaagaaatattaagcatgttttgttgctcagtgtttttgtgaattgcttggttgtaattaaattctgagcctgatattgatatggttttaagaagcagttgtaccaagtgaaattattttggagattataataaatatatacattcaaaaaaaaaaaaaaaaaaaaaaaaaaaaaanaagnaaagn

SEQ ID NO: 3391 - DNA, 2007 bp, Homo sapiens
ccacgcgtccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcagcttcctctgcctccttggagcccatgtggtcgggcagtaccatgcggcggatggcgcttcggcccacagccttctcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggacccccaggccccactggacccaaaggaatctctggccacccaggagagaagggcgagagaggactgcgtggggagcctggcccccaaggctctgctgggcagcggggggaacctggccctaagggagaccctggtgagaagagccactggaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggttccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgcaaaaaaaaaaaaaaaaaaaaaaaaaaaaaaaaaaaaaaaaaaaaaaaaaaaaaaaaaaaaaaaaaaaaaaaaa

SEQ ID NO: 3392 - DNA, 4841 bp, Homo sapiens
acatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggactctagcctaggccgcgggacggataacaatttcacacaggaaacagctatgaccactaggcttttgcaaaaagctatttaggtgacactatagaaggtacgcctgcaggtaccggtccggaattcccgggtcgacccacgcgtccgcaggaagagaccgacccgccacccgccgtagcccgcgcgcccctggcactcaatccccgccatgtgggggctcctgctcgccctggccgccttcgcgccggccgtcggcccggctctgggggcgcccaggaactcggtcctgggcctcgcgcagcccgggaccaccaaggtcccaggctcgaccccggccctgcatagcagcccggcacagccgccggcggagacagctaacgggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggacgccgatccatggtttcaggtggacgctgggcaccccacccgcttctcgggtgttatcacacagggcaggaactctgtctggaggtgaggcagactaaccctaggtcaggaggtcacagaaggactggggtgggagtcctgggggcaccgatgatctctctccacctctcctgccaggtatgactgggtcacatcatacaaggtccagttcagcaatgacagtcggacctggtggggaagtaggaaccacagcagtgggatggacgcagtgagtggtcccactgtggctggggcctccatgctgggagttgggcacccagtccaggctaggctgaggctcctctgaggacaaggaatagacgccagcttaggcttcccaggggggtgtggcttgttgtcaagagggtggcacacggcaggcaccattgggagccagctgctttgggacatgcccacatcctccccagataatgccaccacagggtgggtgctgcttcacggtacagcttcctcctggcatgccccttctggcccggggcctctggtccacatcacttcttgccttctcgtggttctgacttccgcatctcatggacctctttttacagcaggctacaatgtggagtcctggccagctctaggattggcttcccccgagtcatgtggccaaactggtctaatgaactgtgtccaatccagagagcaaggctgcctagggctgcccattggcaggggctgtgggccggggtctgtgtttgatgcacagtgcaagtctctagctgagcccactagggtggggagacagtgagcttggaggcctgagctccttccctgggtcctgggccaggcttctggggtttgagcagccacaacagagaacttgctgcccccaggtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcagaccccaatgacctattccttgaggcccctgcgtcgggatcctctgaccctctagactttcagcatcacaattacaaggccatgaggaaggtcagatataacccctatgacctgggaaggagggcccacccatctcaggtccccttcccaccttcccaccggggcacaacctgctgtgactgcgcttgtatgcccctgctgcctcctgatgtctcagccttctctcctgtggacccctaagctccatcccactttcccttattatggcgcccccccagtcctgccccttcctcccggctctgctgccgctcccctcctgtaccatgatgggatgccccctctgtgtgggccatcgctgactttttaagtctttccatggcacatgtgatctgcccctgggtgtacccctcccatgcctcatgccacgctacactctgcccaccagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtgagtattttgagggcggcagtggaggtctgtggggggcggaccttgtctctgtctcctgcccctcctgacctgccccatccaggtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagagagggagggacaaagtgaggaaaaggtgctcattaaagctaccgggcaccttaaaaaaaaaaaaaaaaaaaaaaaaaaaaaaaaaaaaaaaaaaaaaaaaaaaaaaaaaaaaaaaaaaaaaaaaaaaagggcggccgctctagaggatccctcgaggggcccaagcttacgcgtgcatgcgacgtcatagctctctccctatagtgagtcgtattataagctaggcactggccgtcgttttacaacgtcgtgactgggagatctgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcgatcctgcattaatgaatcggccaacgcgcggggagaggcggtttgcgtattggctggcgtaatagcgaagaggcccgcaccgatcgcccttcccaacagttgcgcagcctgaatggcgaatgggacgcgccctgtagcggcgcattaagcg

SEQ ID NO: 3393 - DNA, 1251 bp, Homo sapiens
ccacgcgtccgggaaacagggtcgaatcggggtcctggagtctggttcgagcagatatgtctctctttgtcttggacaggagtgaggagaatatggggagaggaacagttttttctttcacaatgttgggactcacaatatgtatctcccctgccaaatggcttgttctttatttgtgctatttgtgatatggttgctcttgaaaatttttcaagctgggccacagctcatgagtttggctcatgggtcagctaccctagtgctagatgggatgaacatctttggccctagtggctatggtcaggagtgcagggtcgcatgcaactactttagaaaatgtagagttcccagctgggcgcgttgtctcatgcctgtaatcccagcactctgggaggctgaggcgggcagatcagctgaggttaggagtttgagaccagcctggccaacatggtgaaatcctatctctattaaaaataaaaaaattagctgggcatggtggcccatgcctgtagtctcagctacctgggaggctgaggtgggagtattttttaacccaggaggcggagattgtggtgagctgaggtcacgccattgaactccagcctgggagacacagtgagatcctgtctccaaaaaaaaaaaaaaataaaaataaaaaaaataaaaataaataaataaataaaaggatatttccccactgtgtctgccaatggttctcttccgaggaaacacactcctagcttcgtgctttggagccatttctcaggagaatctctctggagaatgatttcctccttgttattcatcacggtcctttcaaactgaattaaatcgtcctgcctttggatttttgtttgctcaaggaacttaattttactaaactattctctcgcatttatgggatacttttccctcaagagcaaaactggggcaacttcagagcacacatgtgataaaatacctctcctgggcactaccagtcagaagacaaagtaagtgacatgaatgtcaataatgaagttcctattctcattccctcacatacttgagtcttctagtcccctacaaagtctctccaaatatttctgactttaccaagagaaacctctcatgtggccacgaaccagcctgttgtatgtagtccccaggtggctcctgccatgttcttccctcccctgccctctccctgaaataaagaacagcttgacagaaaaaaaaaaaaaaaaaaaaaaaaacaaaaaaaaaaaaaaa

SEQ ID NO: 3394 - DNA, 2769 bp, Homo sapiens
ctgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaaggtcagcaaagtaccattttaaagcatattgtgttagtatgcaaaggctttctctgaaatggagtttaaatgggaaagtatgaaactttgcaaactcacacaatgtagttttctcctaaagagtctgatccttcttttagagcagctgaatgtttcaatgggttttgttgctgcgtttgatgtgcttgttggctgttctatctgctttgagaaacattgaaaaaaaaatcattttaaattatgtgttgagtgttctactttagaattccagaccttcattttagctttttatacacaaaatagaatgtgaaaaggcccaaacattaacatgaatataaaagagtgacaccaaacacataattagtttgaaaattcagaatttagaacatttatatgctgagcatttcaaaatatgttaattatttattgcaaaagcattgatgccattgttattgcattatacttaagggtaaggaaagccaagtaatagcgatgatgattgagctatgcttagaagaaaggggtttagaaagttctggaaatgttaatagagtctgtagattagtttaaacagcttacacttactttagaaaacttttggctttgtgtgtgtgtgtgttttaacattttaagacataaaatagtcttgtgtttttgtagattttgaagtgatttcacatatatcatctttaaatctttataattttggaattggacagcaaaggtactaatttccccattgtagagaagagaaactaaggctgaaattaagaaaccaaaaaaaaaaaaaagtcccacagtagaagaaataatactttctgcgtttcagttagtgctctttatgcaaagcggccaccgtgaaatacacatgtaaccagtaacaaacattttatggtctactttaaaaaggccctaaatatttaagtttgacttgagaagatttttgcctcccttggaggtagtccgggatagtggggggcaagtgggttttgtagttgagcttaaatttggataccaacttagctccttattagttctgtgacttcgggcaagtgattttacctctctaaactttaatattcttcctgttaaaatgtagctgtctcttaaatttagtgagctaatgtgtattaaattgcctagcatagcgtctagcttaataaatgttagttttttcctttagtatcagctaaatttttttaacagtataatttagagcatataaaatgttctcaaataaataattggttaaatttgttttgtacgtgtaagaagcccatagatatacattagtatgaaaatcaaatatttttaaaactacaatttgaagtgagaaatttttagcagtgtttcttagtgaagcagatttctggtttttattcatattcaatttgtgaccatgttgtagagacatatttgtctgtacaaacccatctcatttcctggacaacaaaccatagagtgtcataatcatagagatgatcagggaggagaaagacatgaagaaaaaaatgagtgttaattatttaagcaaatatttttagtgagctgatggaaatacagacaaccatttagcatgtttatttacatgtttatgcctaaatactttcgttaatttttcattttagttaaggggattctcatttaaagtaaggctacccttttagaaattatatataaaatataacatgtataagtatcaattctgtcatgccctttaaaatgttttgagacagggtgtcttaaaaaagttgtttgcttctgtaatgaagtgtctaatctgtgccacctcattgctatttcttttttattattgacattttaaagaatacataaaagtagagagaataaaataagccccatatacccatcaccacagtttaaccagtatctaatcttgcttcttttatcccttcttctctctcaagctggattattttaaaacaaatatcaaacatcagatcacttcatacataagtatttctgtattacagtgactttcttatattaattattgatataatttaattgttaatataattattgtattaatttttaattactctgtatagtttataaactatttcttggaatattctagtttatttcagcaaagtctcttgtgactctcctgccctcttttcaagacagagtgctgcaggaggctaccgcttctagtatatagtatatcctataacctatgttgaaattgtaggccatgctgctagattggagttcatattgttgctctgacatttacttgtatggccttagcctaataatttaatcttttttgcttcaattttctcatctttaaacgggagcaataatagtgcctcatcctaggtttttgtgaagattatttgaggcaaattcgtgtaaagcatttaatttagcacatgctaagtgctcagtaaatgttagctaaagttaaaaaatttttaaaacctaaatgctagctgtagagtgtttactgtgtgccaagaactttacaaataagaactcctgaggtgggcatatcacttgcggtcaggagtttgagaccagcctggcttacatggtgaaaccccatctctactaaaaaaa

SEQ ID NO: 3395 - DNA, 573 bp, Homo sapiens
ggcacgagtgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccggaaaaaaaaaaaaaaaaaaaaaaaaaaaaaaaaaaaaaaaaaaaaaaaaaaaaaaa

SEQ ID NO: 3396 - DNA, 1241 bp, Homo sapiens
  misc_feature (8)..(8): n equals a,t,g, or c
  misc_feature (59)..(59): n equals a,t,g, or c
  misc_feature (78)..(78): n equals a,t,g, or c
  misc_feature (84)..(84): n equals a,t,g, or c
  misc_feature (86)..(86): n equals a,t,g, or c
  misc_feature (104)..(104): n equals a,t,g, or c
  misc_feature (128)..(128): n equals a,t,g, or c
ggcacganctgttatcctacttcctgctggctgcctttaaacatggagctgctacacanacaggtcctggctctgcanacacananggtcctgctggagaagangcggaaggcttcagcctgggaacngaacctgggctaccccctggctatgctgtgcttgctggtgctgacsggcctgtytgtgctcattgtgggcatccacatcctggagctgctcatcgatgaggctgccatgccccgaggcatgcagggtacctccttaggccaggtctccttctccaagctgggctcctttgcctcttcagcctccctttctgcaagataggggcaagggcggctagatggatgtgtctgctgggcaagtcatataacatttctgatcctcagtttcatcctacaaaatgggcgtaacaatgtctacctactccattgtgtggaccaaaggagatggttaatgtgaaagccctttgtgaacctgaagtgagcaactgctggatgaatgtcattacgggcacaggctctgtgtcatctcctctcctagtgcttccacagccaggaccagagacctccctgatgactggggaacctggtgatggtggcctttctctttatggggagcctgagtatgctcagatcgcagctttccttccctagacattgtgtaattgggggtgggggcacacttgccccacwkcctagctccagcctttcctcctcttaggatggctcaggatgagtcccccctcaacaaggcagctacccaagagtaattcccctggggactttctgtgtgaatctccccttccccctcctctcttttccctttcctggacccagccactgatgtaaccaacctcacagactagttgtttattatattaatagtttgagcatataaagaggaacttgtgatgggagagatctagggaggagtaaagaagtataggaatgtctggcctgtattctcttcacctgggaccactgatttttaagctgccacattggctggagaacaggctatggagttcataatgtgtggtctcctggagctcctgttcagctctgccttctttgagggggcagggatggggcagggagcacatygtaatactaacggcctcagagmtgccccctgatgtcctcctgcctgttaccccgtgcctctgtctcttaacagtgggatgatgaagatgccaccgtcaacaagrktgcgctcgagctgtgcamctttaacctggg

SEQ ID NO: 3397 - DNA, 3416 bp, Homo sapiens
ggcacgagatttggtagaaggcttcagagaataactgggggactcgggggagaagataggacaggtcagggagaggctgggaattcaggcaatgggaaccttgatggtcttgacaagattagctgtgctgttggccacctccttggctgactgtacaaactggcgcttggcagtaggattggtggtacgggcagaagccaggcgacagctgttacacagtgcagaggtgtgtttagccacaatggtggctgcagagagcacctgggcctgggtacagccaggctctcccaaactctggcaggccatctgaattgcctggtttgcacgggcaaactgtgtgggctccactagcccttgctgtccagcttggctattggggtcagagacaccaaccagatatgcagcctgtgcagctgcctcggtgaagccacaaagtgcctttgaggctgtggaaatggcatctccaaactctggcaggtttccgttcttggcattttgggagatgccagtcatggcctcgcccagcacctttgagttctccattacactgtccaggcaaccaaagtaggacatgtcattgatgggctggactgggttctccaggagttcccggaccgtctccaattcccgcagggcgttatcacactccttctggccgggtgcctgctgggtgcacatagtgatgagctgattgatgctgtcagttactgccctggcagctgcagccagctgactcttgaggttaggggcagcagggtccgtggacagggccttggcagccagaagaagtttgcttgaagacatggagatgcccttcaagttggacacaacttgggctcggtcctcctggctcggagcctggcctgccatctccacaccagcttccaggaaggtgctgaagtcctgtccaaatcggcctgaggctcgagccaggtcctgaggggttccccgagaggcctgcaccagttctgtggctgcctgattcagcccagcagcagcttcattcaaccggctctgagcttcttgaaatgtcccagtgctaggaggaagcgagtcactcaggagtcgcttgctggcatctccaactgccctcagggcattatccacatcgcgctggccaggtaggcagctgacacagcggttcagagcctgggtcactgctttagccacctgggcaagccgctgctggctctcagggtcccctggatggccagctgcctttttcgcctcctcaatgaggctgctggccttgtccagcacatcactggccgtatcaagtacaatggcctgcactgcaggatctgacgtcagtgcagcgactcccctagcggcctgggccagtgaccgcagcccacctgccacatcccgagctgcaatacctgcataattctcattgccctgggcaacctctcccagtagctgggcgatggctgagctcacggctttggtgctgttgcccaggtcctgggtacacttctccattgtctccccaggtaagggtttaagcttgccatctcgagctgctgccttcacttcctgtagatctttctctagattctgtaccacactcagtgcagaatccatctccaaaggtccacatgcttcctgagccttctgggcagccgtccggagttcagccagcgcggtgcccaggttcttggcacactgactcagctgcatggctgaagcctggtcctgaatcgttggcactgaggcctttgcagctgccaccatcttcccacctggctgcaggaagctctggctggcagcaatgagggcaagctgagcgctggggctgtcaggctgggcttggcttcctcggacgccctgcaccagcagtggaatctgctctgccactgccttgcagctctgcaccagcaggggctgggggccggcagaggccttgggggtagaggctgcgtgctgagctgcagcgatggtctgtgtggctgaggctgcagcctgcttggctgcatgctgtgaagacaagagtagtcagaccaagcccatggattcccatgcccagcccagtccctggcctaccttgcccaggttatgcctcaaggacgtattaacttactctccgcacctccctttcagttcattcctcccacagcacccacactctctcttgctcctggtgaaactcccagcctcacctccaggcgctgcaccagctttttcttgatggcattctgcgcagctgcattggtggccatgcgcagcccctcagctgcctcccgcagccgctgctgctgctcctcactgtcagggtgggcagctgctcccttggcagcctctaccatcttggctgtggcatcagctaggatcttggcagcacttaagagcttgcgggagttctccagatcactttccccctcagcatcagccttgatggcattgaccaggtcagatgtggcttgggccaggatgcgggcctgtcgcaccatctccccagcatcacccatggagctaaagatgttctcagtgacggttaggatggtgtcagtagcctggtcataacggccagcaggcccagcccctgtggcatgggctttcacatgctgcagcagctcatttagggcctgggtgacagctgtggctgctgctcctacccctcgcaacagttgcccatcctctgtagctgcctgggaggcagacacacagccctccacggctttggctaccagtcgtccagcctccaccagttgctcttggcagacaggtgagctgattgtaggtgccaccaccttagtacaggccactagttgggaagtggatagggcacactgtgttgctgcagcaataacttgggtctgaagtcccgagtcctctgtccgctgggccacactcttggccttgaggaccagggcagctgcagcacttgccacagctttggcgagctgcattagcgcatcctgtgagaaaacagcagttagcatgacctgagattgggcttgggattcacagacacttctcagaggcgtaagctgcttcattattcccactgatccaatcaaaggagagtgtacgcagaagcaaccagaacctaccccgagctactgccctgagcacccagcaggacagaacccccaccgaggaacaaacccacaccaagagaaaatacagcctacaccaaatggagacacacatgaggcggatacactcgatgatgacggggagacaatgtggtggcgctgttacaatgggatggggagaggaggtaggaggtatctcctgggatccctccacccccagcttctttactccacttcttgatcttggattggaagtggtcatcctggagtcttgggagcaagtccctgtactaccctacctgatcccatttcccaaagcctggcttcgccaggcctcctcatctcccaccaagttctggtcccccaggagcggcacga

SEQ ID NO: 3398 - DNA, 1777 bp, Homo sapiens
  misc_feature (58)..(58): n equals a,t,g, or c
  misc_feature (118)..(118): n equals a,t,g, or c
  misc_feature (237)..(237): n equals a,t,g, or c
  misc_feature (661)..(661): n equals a,t,g, or c
gattgtttacgatcatatccggcgatttgggtaccgggcccccccccgactttttaanttttttttttgcgagacagggtctcactttgtggctcaggctggagtgtactggcacgtncttagctcactgcagccttgaactcctgggctcaggcaatcctcctaccttagcctcctgagtagctaggactacaggaatgtgccatcatgcctggctaatttttaagttttttgtanagatgggatctcactatgttgcccaagctggtttcagattcctgtgctcaagggattctgctaacttggctccccaaagtgctgggattacaaatgtgagccactgtatctggcccatattcttttttaagaaaaagatgcagaggtgttaaatattaatatcaaattgtccaggcatggtgtttatgaaattgtgtgccctctgacaggcaaccaaacacacacgacttcatttctttattaattcctgcctcatcatcttttctcattgatgctccttaatgtcaaaggaatctctctctctcacacacacataagaccaaaacaaatatcttgaacatgcaaaaaaatagtctacgcttttgaatagtgtgcactgttgaatagtgtgcactgttggatagtgtgcactgttgaagtgtgnatgtgcctaaggcaacaggatcttgggaaagctctagatttttggcytcgaaataaaactgcatgttgaatagcaggtttttacatttattattgttgtgtatttcctcccctttttgcaatactatctacgctgagttatctattgccaactagcaccaattctccaaatcaaagtgtgtgaggaaaacacactcgtgcaatcctctttaacagaagatacaccaagtaacctgtctgtctacttctgttacccagaaataaaagaacttgaagggctgcttggctggaggggtccgggtgggagagcatcctgccctcagtcggaatccatggtgaacagctggatgtcctgtggattccagtacaggccgactgctgagttgtagacaagagaccagacataggggataaaaaactcctcgggctgctcctcttccacatatttgaatttcaattctggaaatttcttcagtctgtctttgggcagcgcaacgacgccttgcttaatgatttccaggacccgttccactgacagctcagctcccagcttgcagcaaccttgagctaaagaaggagatcaccagatcaatattttgcattatatcctgaaatgaaggatgagttcgaaattgttcaaagagatcgcgtttgtaaagcagggcgtataccaagtttgggttgtggtgaagggaatttgtcaggcaggagttgatgatctctaacatcattcgaatcacttcttcaatgacatttaggtcttgtgcataatctggtagaggaacatcattagaactcagcgaacctctcaaggactgtgtggcttgttccagaactttgttgtgttttttagacagcaaagaaaataaactgatgatcctctgggcagcatactgatggagagaacgaaactgtgccgacatatttgctaaagctgccaaacaatttgtgtgaaggtacttgtctcgtgtcctagtcatgttgtattgaatggttcttattaccaccaggatcaggagactccccaaggagatttcagttaaaactcgttctgaataccaagtaatattttttagtatcacttcatgaatggatctgttgaagccatcatcttccg

SEQ ID NO: 3399 - DNA, 930 bp, Homo sapiens
gaattcggcacgagctaagtcctgatatcccatgatgttttttgttttactttgtttttggctatttcctttttctaaaaatagccctctctggggaatgctgagatcttcattctttattagtatcaatttataattatctacatctgtaagcagttattcgaaagtctccagatcttattctatcctggcacccatggtgactaaaaaaatcaaagacgttaaatctttgaaagcagccttcaaaccacatactccaaccaacttaccttatatgtcggggagttatggagcaaatacattaattaacttgacagaagttgcacactttctgtacttctgaaccaaaatttggatgcatgtttttctttatcatgagtcacacctgattaggatttccttagcttttgttggggtcagacaggattgtgaccaaaggcaagatttctctgtcatctcttttgacagaatttccacaatcatggattttgtaatagtcctggacattcatcagaaagtaacctgtagtggggctgcctacataggattcttcctttgaaaagccttaaacatttttctaatggttggtctctcttaactaacaataaaaaacagcaacaatgcasctgggcacagtggcttttgcctgtaatcccagcactttgggaggcccaggcaggtggatcaactgaggtcaggagtttaagaccagcctggccaacatgtgaaaccctgtctctacgaaaaatacaaaaattagccggatgttgtgttgcacacccgtagtcccacctactggggaggctgaggcaggagaattgcttaaacccaggaggcagagcttgcattgagctgaaatcgtaccacagcactccagcctgggcaacagagtgagactccatatccaaaaaaaaaaaaaaaaaaactcga

SEQ ID NO: 3400 - DNA, 963 bp, Homo sapiens
aattcggcacgaggttcggcgaagatagggaataaggaagcacaggagtaggggagaaggaagcacaggagtaggggagatatacagcggtcaggataagggggaaagggcggtggttgcgcaagaggtgaaacaagatgtgagagacaaggggtagggaagaaatggggcagcggttaggttcagaagcgcatagaccgtggcggacgggcaatgcgaggggcacagaaaggaactgaggggtgggctatttaaggagatggtcctcagccctctcttttctgcgtaggtctcctcctccaggccgcgcgcggatatgtcgtccggaaaccagcccagtctaggctggatgatgacccacctccttctacgctgctcaaagactaccagaatgtccctggaattgagaagttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcattatgaagaacacttggagaaacatcgaaaggacaaagcccacaaacgctatctgctaatgagcatttgaccagaggaaaaagatgctcaaaaacctccgtaacaccaacttatgatgtctttgagaagatatgctgggggctgggaattgagtacacttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcaaaaaaaaaaaaaaaaaa

SEQ ID NO: 3401 - DNA, 668 bp, Homo sapiens
  misc_feature (659)..(659): n equals a,t,g, or c
gacgacagaaggggctcttctctccccaggcatcaagtgaatagagaagattctatggatgtagaagaggtccctgggtttccgaattgccactggattgcctctatcaaatacacaagagtttcatgagtgagaaataaccttctgttgctttaaatcttgggttgtgcaatacatcagtgagcctaccatgactaatacattctatggatgcagatttctcttctctggccattgacatgagtgtgttttctggatgcaggttggtgtatattgctatcattttctgccttctcatgtttgatctggctcttaaccagttatttttggtaaacactttatacaacaacctcctttcttctagagattctagtttccttgaaatgaactttagttatgagtaatattaaaaatgtctctgtgttctgcacatgggcacagggaagggaacaacacacactggggcctctcagggggtgtagtggggtgggaagagggagaacattagaaaaagtagctaatgcatgctgggcttaacacctaatgggttgataggtgcagcaaaccaccacggcacacatttacctaggtaacaaaccttcacatcctgcacatgtaccccagaacttaaaaaaaaaaaaaaaaaaaaaaaaaaaaancgcggccgc

SEQ ID NO: 3402 - DNA, 908 bp, Homo sapiens
ggcagagaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttctttgcttttaaaaaaattcctggtagcaaatcaagattaaataatkgcttcattttcttgagcaatactgaagcaggatgaagtaagaggaatgccattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaaaaaaaaaaa

SEQ ID NO: 3403 - DNA, 978 bp, Homo sapiens
acgagccaaaacactccctccgctcccacttcacttagagtcaaggccaaagtctccactcaccatggcccaccgcagttggattctcagctcctccctgctcccaattcccatctttttcctcctccctccctcctctgcagccaccctagccacaccagggtcctagaatctgttccctggagatgtccacgtggcttgctccctcttctcctccaggtctctgctcagatgccacctcctctgtgttgaaagattcctttagtccacttaatttttcatctcagtgcctaccatgtcctggcattctttattattattattattattatttattagcttgattttctgtggctcccagaacaatgcaagttcacgagggaacagggatttttgtctgtcctgtttacagctgcacccccagtgcctacaagggtgcctggcccagagtaggtgctcaggacaatttgttcaatgaataaagaattcaaccaggtgcggtggctcacacctgtaatcccggcactttgggatgccaaggtgggtagatcacatgaggtcaggatttcgagaccagcctagccaacatggtgaaccctgtctctactaaaaatacagaaattagctgggcatggtggcgtgcacctgtaatcccagctacttgggaggctgaggcaggagaactgcttgaacctggaaggcgggaggttgcagtgagccaagatcgtgccactgcactccaacctgaatgacagagcaagactccatctcaaaaactatataataataataataattcaaccagatgtggtggcttatgcctgtaatcccaacactttgggaggctgaggcaggaggattgcttgagtccacgagttcaagaccagcctgggcaataaaacaagacctcatctttacaaaaaaaaaaaaaaaaaaaaaaaaaaaaaaaaaaaaaaaaaaaaaaaaaaaaaaaaaaaa

SEQ ID NO: 3404 - DNA, 1269 bp, Homo sapiens
ggcacgagcagggctaagcctcctgtaaaatgctctttaagattattgtagcaagaacagaaatgctgcatggctgggggtggggagagaatgccaacgagacagctgcatttcaaacagttacagctgcaaggattactcatagtaatagcagtgacagacaactgtttgagctttagtgtaaaaggcaatttggggacttgccctgtcagaattttagtagcaagcttctgtgtgcacgtgtgtgtgcatgtgcgtgtgtattttattcaaattagtttgtgtctgaagagtggaaggaaatattttaaatttttacttctcaattgtgctaatgttgaaatcagtagttgactcatctttattaaaatcattgtcctagaggaagtttataaaatgtttatttgtagcaatgatgaatttaaatgtatatgttctaactgaatcacatgtctgcttttccgtctcaaaatttatcttgtgatgattcctgttttaaaaatattggttttccttgtaattyctgaacatacagccttgtytaatataggatccttattttaaaaatttatttcaaatatgatgtmagcttataaaagtaatgcctgtcatgaaatctggaaaatactcaaagaggtaaaggagaaaacaatcattattctagcagagataactgtcaattttaaatccttctggacccttgtttatgcattctagagcatattaagagcatgttaatcatkttaaaggttaaaaatggtaatcattttaaaaaatatttggaagaagtagcaaatggggacaaatttggttttgagaagtcaataacagccattgtgcaagatttctttttcagtgtgcagctattaaagtaacattgcagcctgttttctgtagcagttgtcttttgaaggccttgtacagtttatctcgaaatttagttttatggtttccttcaatttaaagtttgctggctttacagggagtcttgtgatccattgaaatgctaacttgggtcgtgtctcaactgctacaatgctgtgtagaaactgtcattaaaattctggttatcctgcaactggcagagaacccatgctgattccttaggaagatagtacactgttaaaattttgaatcgcaattgtgcttctgtctgccaaatattatcaatatttgtaatcacttaaggttgaaatagtttgaaataaatggaacgttttagtatgtatcttctaaaaaaaaaaaaaaaaaaaaaaaaaaaaaaaaaaa

SEQ ID NO: 3405 - DNA, 2065 bp, Homo sapiens
ggcacgagattaaaaggcctttcaaaagaatgggtttgaaaaactcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttatccccttaatctttggtctttttcagtaattttaagttttctgggattttttttggtttataaaacttgtgtttagactttatcttgctatggagttttcacacttctatagcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctaagcatagtgcctggcacagaattactgctcaaatgttagctgtcgtattaatattgcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtataaaaaaaaaaaaaaaaaaa

SEQ ID NO: 3406 - DNA, 1951 bp, Homo sapiens
  misc_feature (28)..(28): n equals a,t,g, or c
  misc_feature (1636)..(1636): n equals a,t,g, or c
  misc_feature (1947)..(1947): n equals a,t,g, or c
  misc_feature (1951)..(1951): n equals a,t,g, or c
ggccctgggctcgcggcggtgccgsggnggatggcgggagccggagctggagccggagctcgcggcggacggcggcgggggtcgaggctcgagctcgcgatccaccgcccgcgcaccgcgcacatcctcgccaccctcggcctgcggctcagccctcggcccgcagatggatggcgggtcagggggcctggggtctggggacaacgccccgaccactgaggctcttttcgtggcactgggcgcgggcgtgacggcgctcagcatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccangctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggaaaaaaaaaaaaaaaaaaaaaaaaaaaaaaaaaaaaggggggncccn

SEQ ID NO: 3407 - DNA, 1654 bp, Homo sapiens
ggcacgagggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagaaaaaaaaaaaaaaa

SEQ ID NO: 3408 - DNA, 700 bp, Homo sapiens
  misc_feature (81)..(81): n equals a,t,g, or c
  misc_feature (659)..(659): n equals a,t,g, or c
  misc_feature (692)..(692): n equals a,t,g, or c
  misc_feature (700)..(700): n equals a,t,g, or c
ggcagagagcaccatctgtcatggcggctgggctgtttggtttgagcgctcgccgtcttttggcggcagcggcgacgcgangggctcccggccgcccgcgtccgctgggaatctagcttctccaggactgtggtcgccccgtccgctgtggcggraaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctgaaaaaaaaaaaaaaaaaaaaaaaaaaaaaaaaaaaaaaaaaaaaanaaaaaaaaaaaaaaaaaaaaaaaaaaaaaaaangggggggn

SEQ ID NO: 3409 - DNA, 2776 bp, Homo sapiens
  misc_feature (2762)..(2762): n equals a,t,g, or c
  misc_feature (2773)..(2773): n equals a,t,g, or c
aagagctggagctccaccgcggtggcggccgctctagaactagtggatcccccgggctgcaggaattcggcacgagccggctcgcggagtgcctgcgagcgctgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacggsttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtrcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaaggacacttggaccgtccacctgccccagcccaacagtcagtcatctgtcatcagctcagctgagcagccctggatctttgccgtactgtgactgggctctttgccckrtttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtgggscgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaagggggggcccgtacccaattcgccctntagtgagtcgntac

SEQ ID NO: 3410 - DNA, 4202 bp, Homo sapiens
  misc_feature (57)..(58): n equals a,t,g, or c
  misc_feature (61)..(61): n equals a,t,g, or c
  misc_feature (4137)..(4137): n equals a,t,g, or c
accagctcaaagattcatgagtttcatcgagtcactgtgagtggagcccatgctggnntgntgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggggttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttcttgtcctctctgcagatgcccagtaggggctacctcatcctcgtgctgttcttgtgtggctttctgggcagtagggatcttgaatttcctttctaacactgtgcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccamaaaattgttacycttgttggccttctgctgtttgtagattagtgcacctatctgtgagggatttgggttacctccctgagtctgtaagcaaccacaagccctgccactgggtgggggaagtccctccccaaccacttaaaaacaaattttcccacatattaccccaccccacacatttgaccctggctagactttgtttgcctaaaggaacagaccacattgctgggaaaatgagtaagtgaacgtgtgggagaaaaacacttttagaatcacgaatattcacttttaaaggtctctttgcctggctgcaatatagtgtgtgtttaaattatttacaggctgttgtttctcaaataaatgtttaatattaatcattcccaaactgacaagaacacaaaaataaaatgcaaatacagagccagctttgtcacccaaatctgtgtctatttctgatagtccatggaatgtggttttcttggaagccagggttggtctccccacagaccccaggctaaggtcaccagttaggaacccaggacttggaaggcagagctgtgagctcttccatcagggatctgactccgcaaaacgacttgatgaatgcaattggcaaactcccatgttcggacttcatatgcatgagccgttggacagagggtttcttagtatatactttaatgcatgtttatgtgcaatcttgttagtgggtatacaagtttgtgaagaacttctcatttcaataggcagttaatgtaatgcattaaaagcctgggaatttggggctatatttttcctttctgactcaataatcttcaaagaattcataggaaagtcagtacttgcagacaagtggttagcttggctaaaatgtacaaaacacccagaacccacaaaacactcagaggtttaggagaatgttttaatgcttaagaggcaggatcaagtgaagaggttacagaaatcagtgtctctggctgggcagtcaagagagcgggctcaaattctgtgactcacttctctgtgtctcggttggaaatgaatgggtatcctggttcccaccttcccacacgctgtgatacttcaaactccttgggtgaagggcctcttctcagcccaagatcttgattgtgaacattaacaaagagaacagtcatcctccacagaagataactcattaatgacatttgattcagtgaataaatatatcatttaaaaaaatattgtagggggatcatgaaagtagtggaggtaattacaatcaggagagattggtattaaaattgagcaaagtcccaactctcaccagatgacaattatgcatcctgctagatgccccagggctgtcagcctggaactgaaataaatgtgttataagtggtgctggatgcctttttcagttcatttgaaaacatggatttgatcatgtcagctccctttctgctggaaaaaaaagtagtttgcataattggtgttaactactctgttttgattctacagagtaagtaatactcaaatgtggtcttactttaacttcttgcctttgttacccccagaaccatgcagacattgaaatgtggtgtgcgtgtgtgtgtgtgtgtgtgtgtgtgtgtgtgttcatataacaggaggacaggaaaggtaaggacccagaacaatgaagacttattgaaatgtggggggggtgtgtgtgtgtgtgtgttcatagaacaggagnacaggaaaggtaatgaccatccatggaagatgaaggggtagtacttagccggacgcgtgggtcga

SEQ ID NO: 3411 - DNA, 874 bp, Homo sapiens
  misc_feature (461)..(461): n equals a,t,g, or c
ggtcgacccacgcgtccgagcaattgaatcatctgcccaaggataagctgctggtgagagcagagttgggatttgaagtcgagttagaccccagtgatcacagtcttgacgattaaattcttccagctttcatttttcactgagataatggtagtgatagtactgacctctaatgtgtgcatttgtgggtatgtggtccattcagctttaatccccagaagacaaggcttattccttttcttatttttggtcatgttttatttttccattgcttttaacaggattaccaaaggcacactcagtagtcagtaaacacatttctaggaaaggtgttgtgtcatcatgccacatattcatactttcctgggttggaaaatagatcatcagtaaaaacatacaggaaaaatgaatcttgccaatgcaattgttaacctacaaccataatataccttaagtatatntttgcacataagtataacatgcgatttaaaacaataaaccagattgagatctaaggagcattttgtaagtaattactaatgtttattttagagagatcacacaacttcaaataaaaactgacatagattgaacaccttgagaataaactttagtgccaaatggaaaataattttttacaagtaaatttgaagaacaatgtgaactttctataattatatacagraaatatactgatttgccaaaatgagtaattttgatatattaatatttcacttataagaatgcataccacctgatccaggatgggatccaggaacagaaaaagaacattagktaaaaatgacagaaatctgaatatagtatagagtagctaaaaacaaaccaaaaaaaaaaaaaaaaaaaaagggcggcc

SEQ ID NO: 3412 - DNA, 1361 bp, Homo sapiens
cccgggtcgacccacgcgtccgaatttctttagtgtattttatgtacttttgtattaattacattgggtagactgttccataaatgttgaatagatcctatttgttggttaatgctattgttgtgtatcctgctgattttctgtgtagttggtctatcagttgttgggagaagagtgttgaagtctacaactataattgtgtatttgtctattactcctttcagttctttcagttccatttcacatattttccagctcttgattggtgcacattaatgattactatgtcttcttggtgaatagaccattttataattttatgatgtacctctcttgtcactttctttgctctgaagtctacctgatattaatatagtcactctagctttctttggagtaatgttagtgtgatatatcttttttcgtccttttacttttaaccctatctatatcattatattattttaagtgagttttttgtagatagcacttacttgtgtctgtcatgtttttaaatccactgtacaagtacaaatctgtctttatttttcatttttatccttattttgagacagagtctcactttgacactcagcctagaatgcagtggtgtgatctcggctcactgcaacctctgcctccgagggtcaagcaatcctttcacctcagcctcccaagtagctgggactacaggcatgaaccaccatgcctggctaattttttttttttttttttttgtagagatggggatttaccatgttgctgaggctggccctgaacccctgggctcaaacgacctgcccagctcagcctcccagagaaatatgattttaattagcacatttagatcatttactttcaatggaattattgatgtattacaattcaagtctgtcattttatttattgccttccatttttccctccgtttttcatttctgtgctttttttctttgcatgtaaacatgttttaggattctgttttgatgtatttagagtattttttagtgtatcggtttatgtagcttttctagtggatcctttaagtattacattatatatacataactaagaagtatatcagtgtcatcattttaccagttcaagtaaagtacagaaatctttgtcccttttacctgtcctgcttataatgtaaatgtcttaaagatttccttgacacacatttagaaccatatcacagtgttgtttttgcttcagttgtgaaatataatttagaaactcatgagaataaaaacccattatatttatttataaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 3413 - DNA, 487 bp, Homo sapiens
acgtagtagggaaacgtggtacgccgtgcaggtaccggtccggaattcccgggtcgacccacgcgtccgtgtaaactggaatttgcaaggggatgctgtgatgataacccctttctattgctgtaatgttcatataacctgggaaactgagagaaggggatgtgtaaataaaagcttaaacattttagtaatgtgttaaaatgtcactctctcttaccctgtttccctttttttgccagatgatgatttttttatttttattttgtactttactggatgactgtgaagcgatgagtattgggttggggtaggtgtgttgattttgagagtgcatgttaagaactgaaggggaactacttgagatgacttaagaagcatcccatgcaaatatcttgttttgccctaataaaatattcagaaagataaaaaaaaaaaaaaaaaaaaaaaaaaaaaaaaaaaaaaaaaaaaaaaaaaaaaaagggcggcc

SEQ ID NO: 3414 - DNA, 1963 bp, Homo sapiens
  misc_feature (1540)..(1540): n equals a,t,g, or c
  misc_feature (1935)..(1935): n equals a,t,g, or c
ggcacgagctttgaagagagagttcaagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgmacactgcctgtggcccccgagccmggcccagccccaggccagtcagccgcagactttggaaagcccaacgaccatggagagatgggccgttgccatggtggacggaytcccgggctgggcttttgaattggscttggggactactcggctctcactcagctcccacgggactcagaagtgcgccgccatgctgcctagggtactgtccccacatctgtcccaacccagctggaggcctggtctctccttayaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagrgcctgacactctcctaagaggttctctccaagcccccaaatagctccaggcgccctcggccgcccatcatggttaattctgtnccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaaaaaaaaaaaaaaaaaaaccggcacgagggggggcccgntacccaattcggcctttggaaatgagat

SEQ ID NO: 3415 - DNA, 1785 bp, Homo sapiens
ggcacgagcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacagtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttaaaaaaaaaaaaaaaaaaa

SEQ ID NO: 3416 - DNA, 605 bp, Homo sapiens
ccacgcgtccgcccacgcgtccgggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacaaaaaaaaaaaaaaaaaaaaaaa

SEQ ID NO: 3417 - DNA, 702 bp, Homo sapiens
cccacgcgtccgattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtggttgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattaaaaaaaaaaaaaaaaaa

SEQ ID NO: 3418 - DNA, 2575 bp, Homo sapiens
ccacgcgtccgcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactacttctacgacctcctcgtgtgcgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggacagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccatggagacagacagacagacgcttgtcccccgggaccgaggcctgtgccgtccccacccgccccaacatggtgcttatccttgccgagacccctgcagtcgtgcccgcgcccagcccagctgccccggctgcacgcctgctgctcccagctcgcccggctgccacaagctttctgcgggtccatcctccccgcaggaggaggggtccgtccttcgcaggccttgcccggcctctctgcagaccctcaagcgtcgtctgcatgagtgagcaggcgtgggtggactttggccgcggccacacttggtgctcaccagctgcttcggccttcaggtgacctccctccccacggcatcctgctctccgggtggaagagcagctttttgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttcaaaaaaaaaaaaaaaaaaaaaaaaaaaaaaaaaaaaaaaaaaaaaaa

SEQ ID NO: 3419 - DNA, 663 bp, Homo sapiens
  misc_feature (43)..(43): n equals a,t,g, or c
  misc_feature (64)..(64): n equals a,t,g, or c
ccaatcggctaattcaactcacatagtagggaaacgtggtacnccctgcaggtacccggtccgnaattcccgggtcgacccacgcgtccggctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaaaaaaaaaaaaaggcggcc

SEQ ID NO: 3420 - DNA, 2271 bp, Homo sapiens
gttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgttggatcctcctcctttctctggagctgtgcttggggctactctgacactctgtctcttcatcaccagccaaggaaaggggctttcctgataaagacaagagttggttagagaaagggacacctaagtcagtctagggttggaagctaggagagaggtgagggcagaagggcacagctttcaggaacaaggaataggggctggggtkgtkgttctcacgggtaggcgtacctgcagggcctccttgaagtacttgggaaggaggaagccatcagtattccctggagtcagaatcaccccattggcagagcggaagaagggtattccatctgctgacagagccagagatgtgactcatgccctccccgaaggcaaagtcagctcctgctttgtccagactcacctgccagagccaggggtc

SEQ ID NO: 3421 - DNA, 1688 bp, Homo sapiens
  misc_feature (912)..(912): n equals a,t,g, or c
acccacgcgtccgctcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctataaatcaactaccacttttgtgaatctgacaggccacatttttatatggccctttacagaatggagtgtgttgaacaggatactaacgccatggagttgagctgggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagangtcacttggtttgggcttcattaggactggagactttgttggagttctttctgggaacttggagagtggatgatattcaggctctgaaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagagggatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactgttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaataaaacacacgttaaacatc

SEQ ID NO: 3422 - DNA, 2127 bp, Homo sapiens
  misc_feature (312)..(312): n equals a,t,g, or c
  misc_feature (1212)..(1212): n equals a,t,g, or c
ccggcgggagagggaagctgcagcgagaggcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagcgcnccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctracacggcccccatcatgagtggccagggcctagcaggcttctttgcctccgtggccatgatctgcgctattgccagtggctcggagctatcagaaagtgccttcggctactttatcacagcctgtgctgtkatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagctggntgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcagagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggaaaaaaaaaaaaaaaaa

SEQ ID NO: 3423 - DNA, 746 bp, Homo sapiens
  misc_feature (61)..(61): n equals a,t,g, or c
gttacgcccgcaggcaccggtccggaattcccgggcaaggaaggctgtgtgcttagctctncccagagggagggcgwgaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccacaaaaaaaaaaaaaaaaaaaaaaaaaaaaaaaaaaaa

SEQ ID NO: 3424 - DNA, 2829 bp, Homo sapiens
gagatggcggatgacaaggaagcttttataggaaaaggtctttctggctcaccccatcccctcccaattcccagcttctgatggaattgagcaaggggtggggcttagtcagactgctggagccagcctctcgcttgtcctaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagccaaaaaaaaaaaaaaaaaactcgagggggggcccgtcccaatcsccmtatagt

SEQ ID NO: 3425 - DNA, 1943 bp, Homo sapiens
aattcccgggtcgacccacgcgtccgccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacaaaaaaaaaaaaaaaaaaaaaaaaaaaaaaaaaaaaaaaaaaaaaaaaaaaaaaaaaaaaaaaaaaa

SEQ ID NO: 3426 - DNA, 687 bp, Homo sapiens
ccgggtcgacccacgcgtccgactagttctagatcgcgacggccgccctttttttttttttttactgccaggtagcaggctttattgggaagggacaaagcctcaggagctgggtgccccagaggctgctgggtcttgagccacagctgcagccaatgcagcagtcgcgcctccttcttccgtttctgtttttcctccttgagggttgcgctccttcttctctaggtcctggagcagctcctggaagcgggcactccttgggtccacctggtagcccaggagctcctgggcctcagcctgcagtcgggccctcctctccttgtcagcctgggccttctcccagttctcccgctgctgctgctgccagttcacaatcatctgtggcatcttggccatgcactctgcgatgtgctgctccctctcccgacgcttctgctcttcggccagctgcttcacccgcagcgactcctgcatggtcgccaggctcgggtaccattcgcgttcttcggcctccagctcccgcagctgctccggcgacggccataacgaaccggggaccaccccggaggcggcgccgtaacgcgcgaactgcttagcgcgtagcgcggtcccagctgccaccgcggggtcaggaggtcctcggggtctggccaccggggtcccggtgcggcgcgggggcggccgctc

SEQ ID NO: 3427 - DNA, 551 bp, Homo sapiens
ggcacagctggcgggaccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgaaaaaaaaaaaaaaaaaaaaaaaaaaaaaaaaaaaaaaaaagggcggcc

SEQ ID NO: 3428 - DNA, 1517 bp, Homo sapiens
  misc_feature (144)..(144): n equals a,t,g, or c
gttgagtctttgggtgtgcttttaatggtctctctgcctcttccttaggtgtcaggctgctctacctgtttctagacgctcttcctttcccccttccaaacctcttttcttccttgctgctttcctatcttctgtggctagganatcaggtaatcaagcctgtgttttctgtaatgagtaagtgggttgccagcgaggtctctgtggatgctcctgtgagtcaagtgcatgagctttagtgcatggactttggggtcttggttcccacagcttatatgttttgggggctgctttcttgctctttacccacattctgtgtcatgagtgtgccgggtaggtggcctcctgcccgatggaggctgagcatcttggcagtgtccatcatgccttgcgtgtgcctggcctctttgctgcagatactatggacccgcagctcatcccctgctcaccacctggcctctccttttctctgtgtgcagatctggcagtgtggtggggktctggaaacacacccatgttcccatgttggccatgttttccccaagcaagctccctactcccgcaacaaggctctggccaacagtgttcgtgcagctgaagtatggatggatgaatttaaagagctctactaccatcgcaacccccgtgcccgcttggaaccttttggggatgtgacagagaggaagcagctccgggacaagctccagtgtaaagacttcaagtggttcttggagactgtgtatccagaactgcatgtgcctgaggacaggcctggcttcttcgggatgctccagaacaaaggactaacagactactgctttgactataaccctcccgatgaaaaccagattgtgggacaccaggtcattctgtacctctgtcatgggatgggccagaatcagtttttcgagtacacgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctawmaaaaaaaaaaaaaaaaaaagggcggccgctctag

SEQ ID NO: 3429 - DNA, 2006 bp, Homo sapiens
  misc_feature (21)..(21): n equals a,t,g, or c
tggggaatggaacgatacaanccccaagaacagtagacatgatacgaattaaccactatatagggattgggcctcgagccaagattcggcagaggccgcactagggaaacatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgcctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgc

SEQ ID NO: 3430 - DNA, 654 bp, Homo sapiens
ccacgcgtccgcttggggcagagtcttcaagattttaaggtgatagggcctgtctcttaagaatttattaatcgtaagtgctcactgctggtttagagttagatacatttccctcaaaacagccatgggcaggttatgtactcagaactgccagggtgaaaacaatgagatccagaaaaatcccacaacaatccaggtttttcactcctcttttttttctcaatcttccgatacttgtggtacctcttccatcaacagatacctcatgtagtgacttccagtatcaagttttcaaaacttcctacccaccctcatcagtgcctccttcactacagagtcacaaacattggtgctctcaaataaaaatcagccccaaacaatgtcaaagagatcccttgagtagttttcaggcgagagatatgttctcatttcaagtcttggagaaaactggatccatgttcacgtggaacttctctcgcggaggtgctatctcattttgcattaaactttaagcaggacagattgctgaagccatgatatttaaggtttgactttttaaaaatctcattactcttaaaataaatgctgccacatcagagaaaaaaaaaaaaaaaaaaaaaaaaaaaaaaaaaaaaaaaaaaaaaaaaaaaaaaa

SEQ ID NO: 3431 - DNA, 739 bp, Homo sapiens
gaagccagccccctctgacagcttcctctttggccaagccctgcctctgtacagcctcgagtggacagccagaggctgcagctggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggagaatctgtgcctctgcatcagccccaaagacctgcagcattgagcgtgtcctgcggaaaacagagaggttccagaaatggctgcaggccaagcgcctcacgccggacctggtgcaggactgtcaccagggccagagagaactaaagttcctgtgtatgctgagataacaccagtgaaaaagcctggcatggagcccagcactgagaacttccagaaagtgttagccttctcccaactgggtatacccacccattttc

SEQ ID NO: 3432 - DNA, 739 bp, Homo sapiens; identical to SEQ ID NO: 3431

SEQ ID NO: 3433 - DNA, 4150 bp, Homo sapiens
ggcacgagagagggtagaggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggataaggaagcctgtgtgggtaccaacaatcagagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagaggtcaacacactcatcgacgatgctctggatgggcccctggacttctgcgacagctgccatgtgcggccccctggtgatgaggaggaaggcctctgtcagccctctgaggagcaggctcgagagcctgggcacccgcacctgccacggccgcccgcatgcctgctgctgaacaccatcaacgagcaggactctcccaactcccagagcaacagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtacggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcactggtgggcaggcaagaattctcttctggaaaatgacgtttgtggctctttcccaagttggccttcaaagagcctgcctgccgttgagccagaagatgtctcgtgtgaaggctggggtggcggctgtcttggaacctctgtgagcaggaggccctaagccgcagcagtggatagaggtgcagctctctgcctctctgccctttggtctatgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaacaccttggttatctgtggttttcttgccttgtccctgcctctacccccaccccttttgagtcgggtgactcatttttctgtgtagagactcggtggcccaggcaggaggtgaaagcggccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaagcaaaaaatatatatatatgtccaaaaacagacaaatccaagggtgtgaggtaaacgagtgtctgcatttagattccacaaaaccaaaatccatgttgaacaaagttaagtccgtacacagtgacttttttggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttatttttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcatgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaaaaaaaaaaaaaaaaaaaaaaaaaaaaaaaaaaaaaaaaaaaa

SEQ ID NO: 3434 - DNA, 3674 bp, Homo sapiens
ggcacgagctcaaaagaaatagggtgatttttaaaggattaataaaattctgaaatgttaagtagaagattacattgtctagtcttgtatttcctccttctgttgctctctttcattcacacactctcagtttctcatatttgtagctcatttatttggttatttcctaagaatattgaaagtgaagcaactatgtgactgtattcttcaggtaaacactgactgcgcttgttggattttccctatttttgtgacttcaagaataatatgccctgctgaatacatgccatttcacattctgaaactgggtagagtggttgggtgttctgccaacaattgctagtggtgtgaattcattcatatttgccagtattgctcacttcaaagaaactccttcatcaagcagtccagagctaggccagatcaatgctacaatcatgaagttctcattgcatgcaattgtgtaggattgacaaggaactcagataaaaatttccagggtgcacttccagaaccagcttcaacatatgtctacattgcccccaagttaataaagtgccaaccctttactctctcatacagccagaaatgttagaaatccaaaatcttggtgcattattttttcataaacgctaaaacatttgaagaaacaatttaattatttaaaattcaagtattttattcacattatttgcaatatccaaatgtttaaaaattcccagataattaactagctattacagatctcacctagagggttgatgttatgaagactccagtggactgtactcacaaattgactggacaccctatgaaagtgggtagacctctcagcggaaaataagaagggcttttacctacagggcaggacagggtcccatgagagcagttctgtggagatataaaaagaatggaagaaggaatgccttatagtgatattgtgacattatatctatatatctacatatatctatctatctatatctacatctatataatcttacatttaaaattgtattcctacacatattagaaactcttctaataaatgaagtaaaaaaattaaaaagaatacaaatattccagccccaaatgagaaatcaaacatattaaaattgttcaagaaaatttctttgaacacttctgaaagtttttggaaacttagaaaagagggaaaaaaatccagtgttactagtaatttccatggtaatacagataaaatacattcttttaattctgggaaattagaaaaagtggggtgatctttccaggaaaaacatgtgtaacatctgcttatcactccagctccctcctcctcctcctctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaagtaaattaataaactaataagcattcccttctaggtttttgccaaactgcctatccaataacaaatttgagaatcgttgtaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctacaaatatttaagagcagctcagcttggttgaaactgagttttgtcatcttccatatttgcaggaaggtattttctgacttgcaatgcagctagatgtaaaattttattttatcatcctagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacaaaaaaaaaaaaaaaaaa

SEQ ID NO: 3435 - DNA, 1190 bp, Homo sapiens
ggcacgagccggctactcctgctcagcatggctgctttagtgactgttctcttcacaggtgtccggaggctgcactgcagcgcagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaagaaaaaaaaaaaaaaaaaaaaaaaaaaaaaaaaaaaaaaaaaaaaaaaaaaaaaaaaaaaaaaaaaaaaaaaaaaaa

SEQ ID NO: 3436 - DNA, 4037 bp, Homo sapiens
  misc_feature (5)..(5): n equals a,t,g, or c
  misc_feature (643)..(643): n equals a,t,g, or c
  misc_feature (4025)..(4025): n equals a,t,g, or c
  misc_feature (4032)..(4032): n equals a,t,g, or c
ggttnatgaacgccagctcgaaattaaccctcactaaagggaacaaaagctggagctccacccgcggtggcaggccgctctagaactagtggatcccccgggctgcaggaattcggcacgaktatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcantgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgktgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagcmaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttaaaaaaaaaaaaaaaaaaaaaaaaaaaaaaaaaaaaaaaaaaaaaaaaaanggggggnccccc

SEQ ID NO: 3437 - DNA, 1725 bp, Homo sapiens
  misc_feature (1)..(1): n equals a,t,g, or c
nttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtgaggaccttgaagaaactgcatggttggatcagtctgatgaagcacttgaggcttcctgagcccaggcagatgtgaactcctggcaaggggtgggcaggtccagtttgggaaagtcggggtggagcccagggctggccctggaaatgcagtcctcagagcggctgtgctcataggtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctggaatggttcccagcggttggtgatgggacggcgtaatctctttaccacgagtgttcaggagctggcagagactggaccaatgttggcagcaactttaggagatggtt

SEQ ID NO: 3438 - DNA, 2952 bp, Homo sapiens
  misc_feature (2591)..(2591): n equals a,t,g, or c
  misc_feature (2594)..(2594): n equals a,t,g, or c
  misc_feature (2643)..(2643): n equals a,t,g, or c
  misc_feature (2657)..(2657): n equals a,t,g, or c
  misc_feature (2664)..(2664): n equals a,t,g, or c
  misc_feature (2684)..(2684): n equals a,t,g, or c
  misc_feature (2689)..(2689): n equals a,t,g, or c
  misc_feature (2692)..(2692): n equals a,t,g, or c
  misc_feature (2719)..(2719): n equals a,t,g, or c
  misc_feature (2725)..(2725): n equals a,t,g, or c
  misc_feature (2730)..(2730): n equals a,t,g, or c
  misc_feature (2765)..(2765): n equals a,t,g, or c
  misc_feature (2768)..(2768): n equals a,t,g, or c
  misc_feature (2777)..(2777): n equals a,t,g, or c
  misc_feature (2787)..(2787): n equals a,t,g, or c
  misc_feature (2805)..(2805): n equals a,t,g, or c
  misc_feature (2830)..(2830): n equals a,t,g, or c
ggcacgagctcgtgccgagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagtcactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctcccccacttgatgtttgtgttttgtttggggggattttttcataattttttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcnctnaaacgcaccgaacttccgcgctttgctggtcagtggcggctgtcccctncccagcccagccgnccagccncctgggtctgcctgacccgnacacnccnggggttccggggttgggagctgaaccntccccncctcngggttatatttccctctccccttccctccccgccnagngctctgccnggggcgggcnaaaaaaaaagtaaaaagnaaagaaaaaaaaaaaaaaagaaacnaaccacctctacatattatggaaagaaaatatttttgtcgattcttattcttttataattatgcgtggaagaagtagaccccttaaacgattcccgttggaaaaaaaaaaaaaaaaaaaaaa

SEQ ID NO: 3439 - DNA, 947 bp, Homo sapiens
  misc_feature (67)..(67): n equals a,t,g, or c
ctttctatagttaaagccggtacgcctgcaggtaccggtccggaattcccgggtcgacccacgcgtncggtttctgggttctaggccctgcttccttgcccctttgctgcagaagggcagctgaaggctcaccctagaaaccgggcctggtgggtcttacccggctcactccctcccttgtccttacacatacaggaagacaagacctgagtggtgctgtctttgtgtccgtcgtgtatggctctccctgtcttcatttcttctcactctgtctctaaacctctctctctctcccttccccctcagtacttartctacagacctatgtgcgtgtycctatccttctgtccttttctctcttcagctctccctgcctctcacacacaattttacatgccccgaggagccaagtttgggacatttaccctccaggcatctgtgtcccctcttgaagagaaaacacacagcttcacacatccaggcatagggggcaagctcttggggcatcaggaccctggagcaccaggtccttcctggaatattagatccacctggagcaccaggtctctctaagtctcacctggggaattcggtcccacctgggtcaccagttcccacctagagcactgtgtcctgccctagagcacaaagacctgctcctcccgagactctctctgactgcagccaggcatagtacccttgcctgtgtttgctccctggtccacagatttggtggctgggcaggtgcctggacagtgatgaggtcttgccgccttaactgtcccccccagtcacttctcccacaggcccagcaggacgcagtcctgaggatcagggattctacagctgcattaaaatcaatcctatccaaaaaaaaaaaaaaaagggcggccgctctagaggatccaagcttacgtacgcgtgcatgcgacatcaagctctgaaga

SEQ ID NO: 3440 - DNA, 1015 bp, Homo sapiens
tcgacccacgcgtccgcgggcctccaaggccctgctcccagtgggcgcctatgaagtcttcgcccgggaggcggtgggtgcgggtgcagctcggggcctgctgcctggagatgaggacgctggtcgagctcgggccctgggctggggactttgggcctgacctgctgctcaccctgctcttcctgctcttcctggcgcacggggtcaccttggacggggcctcggccaaccccactgtgtccctgcaggagttcctcatggccgagcagtctctgcctggcacgctgttgaagctggcggcacaggggctgggcatgcaggccgcctgcaccctgatgcgcctctgctgggcctgggagctcagtgacctgcacctgctgcagagcctcatggcccagagctgcagctcggccctgcgcacatccgtgccccacggggcgcttttggaggccgcctgcaccttttgtttccatctgaccctcctgcacctgcggcacagtcctccggcctacagcgggcctgctgtggctctgttggtcaccgtcacggcctacacggccgggcccttcacgtctgccttcttcaaccctgccctggccgcctctgtgacctttgcctgctcggacacaccttactggagtacgtgcaggtgtactggctgggccctctgacagggatggtcctggctgtgctgctgcaccagggccgccttccccgccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttctaagaaaaaaaaaaaaaaa

SEQ ID NO: 3441 - DNA, 1357 bp, Homo sapiens
  misc_feature (1017)..(1017): n equals a,t,g, or c
  misc_feature (1106)..(1106): n equals a,t,g, or c
ggaaacagcccccgcgcagtcggtgtcgctgtgaacggaaaagggccttccttacacaggaaacggggtctctgggggatccagtgacgtgcccaaccacagagaccaggtgagactggctgatggtgtctggggctgcaggtgacttagttgggggacctgctcttggcctccagactgggcctgatggcgtgggcgcctgcctgtgtgcaggcccaagggctcagctgcctctgtctgttcccagacccctcctcctgtagagagtggtgctgccctctcgggatgtacctgcaggtggagacccgcaccagctcccgyctccatctgaagagggctccaggcatccggtcctggtccctgctggttggtaaggctctccacgtccctccccagaaccccagaaccggaagcctgactttcaaaaaggatgaaaatgaaacaaaatattttctcttttttctattaccttgaaatctaatggctattttgtttctttgtatccattcaaattctatctggtgtacttggttttacagataatgcatgtctgttttgtccccttttaatcactaacacccagcgtatttaatatactctatgagcttttctgaggtcaccatattttcctttgtacttgytttgaaccacgtgatgggtgatcgtgggttcccatgtctcctcctccctggtcctcagacctcttcgtaggactcacagtccactaaccacgtgatgggtgatcgtgggttcccatgtctcctcctccctggtcctcagacctcttcgtaggactcacagtccactaaccacgtgatgggtgatcgtgggttcccatgtctcctcctccctggtcctcagacctcttcgtaggactcacagtccactaaccacgtgatgggtgatcgtgggttcccatgtctcctcctccctggtcctcagacctcttcgtaggactcacagtccactaaccacgtgatgggtgatcgtgggttcccatgtctcctcctccctggncctcagacctcttcgtaggactcacagtccactaaccacgtgatgggtgatcgtgggttcccatgtytcctcctccstggkcctcagancctytttcgtaggactcacagtccacttagcctcccgtcctccatcgctamccamcagtagggtcctgtamccttkgggacagctgcacttgtgttgacgggacaccgtgtgaggagtggtgctggctgtacctcagcagctggggcccaccttttttgtgacacgccacagcctcctgtgtgttttgcatgacacgctgtgttgtaatttctttgtgcacagttttcaggcccctcaaaaaaaaaaaaaa

SEQ ID NO: 3442 - DNA, 986 bp, Homo sapiens
  misc_feature (592)..(592): n equals a,t,g, or c
  misc_feature (669)..(669): n equals a,t,g, or c
  misc_feature (767)..(767): n equals a,t,g, or c
gaaattaagtcatttagataaaaatatgccattcttatctgtttggttttttaatcttggcttaatatttggggttgagtcatttgttttgagagctgtcctgtttattgcagggtgttcagcaacatcccagatggaagcagcatccccctacccagctgtgacaaaaagaaaaaaaaatgtctccakacactgccaaatatcttctgggggtgcccctggttgagaaccactgctttagtggataaactttaggcaggagggaaatgatcgcagttggatagttggaggaatgtggagcaagggaagcaataaactgtgaccataaaaacatagaaagatggcttatatgtggatttttttttaaagcacgtagaattgcttaaaatggacaacagcagcatataaatcagtggcagagttggtggctgaatttagagcatcttaagtctatgttctcctggaacagagtgcagataattcagttatcagcttggctaggtgcatgttgaagtatttagtcacacacaaacagttaatgtatggggaagataacttctatactagtaggagagaaatggaacaagaatwntaaatacactatcaaaatatgcaagaatggcaagmggaaaaggcagaacaagctgcaaaacmcacacacaattaganataaatattttgggacacaataaatgtgaatggattaaaacctctgttaatgacaaagttctccagttaaaggaaggcaaatagtgttattaggaatngattactatatgatgattaaaggctcagttcaacaggaagatgattgatagaactttcctacatttgtaacacagtcttagaagatattaaagcaaacattcaagaagaaattgatcacctactaccatagtgtattttattgaattggtacatttcaataaagtgtcataaggcacggttgaaggaaaaaaaaaaaaaaaaaaaaaaagggcggccgc

SEQ ID NO: 3443 - DNA, 787 bp, Homo sapiens
ccacgcgtccgctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaattataccacaaaaaaaaaaaaaa

SEQ ID NO: 3444 - DNA, 1457 bp, Homo sapiens
cccacgcgtccggtgatctgcctgcctcaccctcccaaagtgctgggattacaggtgtgagacaccacgctttgttggccatgctggtcttgaactcctgacctcagatgatccacctacctcagcctcccaaagtgctgggattacaggcgtgagcaccacgctcggccacaaggattgttttgatgaaggcattgctgggattgtttgacagggctcagcatccgatgtccccacatctcatggagacagcagagttgacctcccctggattgtttgctcagaaacgagggttgcttctgctcagcctgtgcttctttccttggcctttgtgtgtgctgtcctcttcccctgcacatgaccagcttccctctgctgaggggaaactcctgaaagtggagatcctgagttctcccccattattctccaggaagcttagcctagagctgtgccctgtgaggcacagaacactagcaaggggattgaatgactgaacagaatgggtggcagtggtgatcttggtcccctgctttgcttggacgttgaggccagccttttaaggagaacatcttgtttgaaggaatgggtataatttgctctctgaatcttgagttgcttcaagcttacaccatccatccctctgtccatccatccaccatgtaccagatttttgccaatgtaaatatctactaaaagttaagcactttcaacatggaggttgggggtctccttgcacttttcatgccctctgaggtagatagtactcccctattttgcagatgaggaatcagataatttcccccggtcacacacaagtggtagaggtgggattcacacccaggtttgtcaacttcaaagcccccgtgctctcaatcactcgtgttagaggcctccctggagagaagatgaccatgtaatttattatccaaattggaatcctttataaaaaagttttattgagttataagttacataccatagcattcacctatcgaaagtacaatctttttagtttttagcatgcttacagagctatgtagctactaccataatctaattttagaacattttcatcctccccaaaatagacactttgggaggccgaggcgggcagatcacgagggcaagagattgagaccatgcccagctaatttttgtatttttagtagagataggatttcaccatattgaccaggctgatctccagctcctgacctcgtggtcaggctcccaaagcgctgggactacaggtgtgagccaccgcgcctggcctgatttagtcttgttgtgccactgcacgccagcctgggcaacaaagagcgaaactctgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3445 - DNA, 1056 bp, Homo sapiens
ggtctaaacatttyaggaatatctgctaaagttcctatgtagatcctcttgagctaccccttgattaactagttctcctcggtatctatataataactacctttgtatttttattgtgatatatcaaaaattagcatttaggagcatggaagaagtagcattcatggttttaaaatatgttttgcctttcttgaagtctctgtggctccatgtttacttactagcagtgctgtggcctagactggcttctatgatatcctttggttccaggttatttcagattgttgatggtgcttagcctctgagaggtagttttagatattaacctatttaatgtaataatgtaatgaaaagttttagtactaaaataagtgtatgacccccacattaattccattacaaaattactttatcaaaaacaaattagctagaaaaaaaattacatcttatgttttcttatatagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaacagtttctaaaaattttttttcctg

SEQ ID NO: 3446 - DNA, 798 bp, Homo sapiens
ccacgcgtccggttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggcgaagatgaaaatgaagagggcactgcatcagagcatgggggacagaacaaagaaccagccaagaagaaaaggaaaaaataaatgaaatgcctgagttaatgtgaaaaaaaaaaaaaaaaaaaaaaaaaaaaaaaaaaaaaaa

SEQ ID NO: 3447 - DNA, 1248 bp, Homo sapiens
ccacgcgtccggcaggcggaaggcggtggctccgagataggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaaccccgggttcagggccagggacctccttggaataaatggatattgttactaggtccccaccttccctcttttctggaagccaaagtcaccctccccaataaagtcctcactgccaaaaaaaaaaaaaaaaaaaa

SEQ ID NO: 3448 - DNA, 1036 bp, Homo sapiens
  misc_feature (43)..(43): n equals a,t,g, or c
  misc_feature (47)..(47): n equals a,t,g, or c
  misc_feature (58)..(58): n equals a,t,g, or c
caaaccccatttacgtgcacactgatacaccgtcacgcctgcnggtnaccggtccggnattcccgggtcgacccacgcgtccgggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagaaaaaaaaaaaaaaaaaaagggcggccgc

SEQ ID NO: 3449 - DNA, 695 bp, Homo sapiens
ttttttttcttgaaataaaatgggggagtaatgggaaataatttttttgagcccttgcgtttctaaaaatgtttgcattgtgccttcatgtttgacagttcagttccaggttgaaaattatttttctttggaatgttaacagctgccctctattttctgtttttatctaatgttgctgaagagaaatcttctgattcttattctttttttggtgacctgttttaattttgtgtctttcttttttttcccctggaagcttttaggctctcccttttatccttgtagtctgagatctgacaatgatggttgtgtctagttttccccaggatactttttcatttgtcctggtcagcactagtagatcctttcagtttgtgtacttctgtttctcttgctctggagaatttaaaaaatatatatatttttgagacagagtctcactctgtcacccaggttagagggcagtggtgtagtctctactcactgcaacttctgcctcctgtgtttaagcgattctcctgtctcagccacctgagtagctgggattacaggtgcctgccaccacgcccagctaatttttttgtatttttagtagaggcagggtttcaccacgttgcccaggctggtgtcgaactcctgacctcagatggtccacctgccttggtctcccaaaaaaaaaaaaaaagggcggccgc

SEQ ID NO: 3450 - DNA, 1205 bp, Homo sapiens
aattcccgggtcgacccacgcgtccgaactatttcttttttctctgggtggcaagattatgaaaaaattttcttacgcttttctatattttccaagtttgaatttcactgtaagcacctggctttgtactgccctttttctgttacacagtcatcatttgcttgcttgttgtgggagcacttttgcacaggtctgcttggttagtgaaagcatgtctccctttctaggaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaaggtgggtcctgccgtgcggcgcctgccctgagtccccgtccccttctcccagttcttagtcactttcagcgcatcgtcgtcacgtggccatttgtgcagccggctctcgggggaggggtaaacaaccctggtttacaccgttgcccaaggggtgagtgggcgtgaggcacgtccatcagtaggcacgtgctgctttcgttctgcaagtgtcaaggcgagtgtcgaggatgaaagcatgaggcgcttgcagggggtcctcggaaccaggtgccactcctcggcctgacggggagccccgccccctcccgggtctccactgtgccccaggcatgcccaccccactcccccacagccctcttggcctgaggtcccttcggagggtgggttggcctgtgaggaagggacgtgtgggcagggcctggggatgggcagggctgtgtgaggagctccagccacaggctcccccatgtcatgaaagcaaaagggggcggggagcggtggctcatgactgtaatcccagcactttgggagggcaaagcgggcagatcacgaggtcaggagtctgagaccagcctggccaacatggtgaaaccccgtctctactaaaaatataaaaattagccgggcatggtggtgcgcgcctgtagtcccagctacacaggaggctgaggcaggagaatctcttgaacccaggaggcggagcttgcagtgacccgagatcatgccattgcactccatcctgggtgacagagtgagactccatctcaaataaaaaaaaaaaaaaa

SEQ ID NO: 3451 - DNA, 1551 bp, Homo sapiens
ccacgcgtccgggaatgagagtggtgtcaggtactttgtttatccactttctggtcttgatattttgattgtttgggtgggtgtttagtagtatatttggttttttggtagagtcaaaatggagtggtggtactgaagatagaatagtgcacggttccactcatcttcccctgagatctgtgtgcatttatgaagtttacaaaatggtagtcgtgatattggaattttcacttgtagaaaaaaaatgctgtgttttccaaatattttgagaggtcatcatagttaaggaaaatctgtctgttcccatatctctttttaataccaagtttatcagttatcagcattgaatagttgttcctccattttttattcatttatccaacatgtcttgagtgactaatattctgcactaatatgtgcagaagatttttttaaacacatctaaatattttttgctttgccacaattaaaaacagtgactattagctgtcctgtctctttcttacctttgacctcttacctctctccagcaaagatctcttctttacaaaaacttgtacctgaccctgctattctcactttattttattttccctattatacccataagaaaactgaggcttagagagtttaagttacttaaccaataccacaagtcagaggcagaagcaaaattcaaacacagataatcttgcatctgagtaatgttcttacctagcactctagactgccttcagcagtggacaagagagatgaggcagtgccaaaaccctccaggctatactgttgttcattctgagaacctgggactcttgacctaattttccctcttgccagcatttttgctctgcttcctgtcactgccaacagagtatggatgtggtcagtaaggtgtggatagtacaggtcaccctgatttccttccttgatctgtgcagaaatgcatgctgtactttctccacttaaagatgagtggatagggacagagaatgacaaaaaaaccaaaacagatcaaaaaccccaccatactggacaagtgtctgagagtatacaaatattctaaaagaggcattttgaatttaaattttcttcacaattaatgcaactctgcaaaagttaaagaggaatagcctgaggagaaaaaatatggtcataatataacccccagcctttcttacttttgatgtacttaacccttattgtgctttgaggtttgaatttttttttttttttttttttttgagatggagcctgggcaacaaagcaagactatctcaaaaaaaaaaaaaaaaaaaaaaaacaagtgttggcaagaatatggagaattggaaccctgatacattgctggtaggattataaaatgatacagccattctagaaaacagtctagagttcctcaaaaagttaaatatagaattatttaacttttgaccaaatgacccagcagttccactgctacgtatataccccaaagaattaacatatccatataaaaacttgtactccagtgtacttagcagcattattcataatagcaaaaaaaaaaaaaaa

SEQ ID NO: 3452 - DNA, 1169 bp, Homo sapiens
  misc_feature (1)..(1): n equals a,t,g, or c
  misc_feature (11)..(11): n equals a,t,g, or c
  misc_feature (1089)..(1089): n equals a,t,g, or c
  misc_feature (1149)..(1149): n equals a,t,g, or c
  misc_feature (1157)..(1157): n equals a,t,g, or c
natagcttttncaaaagctatttaggtgacactatagaaggtacgcctgcaggtaccggtccggaattcccgggtcgacccacgcgtccgggcagtgtggttcatgtcaggaaccttagccagagctctgtacctcctttggcctaggccccactccttggaactttggtcaacacacaaatgacagcactgatggctttggtcatgcacaggcttgcactttatgtgtgtgtcctgtctaccactgcagctctgagaggcagggatgaggctctgggaggagaagcagcctgccttgtggtcttctggggtccacactcacatgacattgaaagacaaggacaagaaggcacaggcttagatttgagacttgcccctcagtgtgcaaaggactcagtgaccgtttctcgttcctgctctgtgtgagaccctgtttcacctggtctaggcttgtagacaggtgggcattccaggcttgaggtgcggtgaccaagcagtggtgacagctggcccttgaggccagggcctgtacctgtctggttctttaactagacctctagcacctaccaaggtgtgagtggtttcccaaaaatcgattgattgacaggatcttgctctgtcacccaggctggagtactgtggtgtgatcgtagctacttgggargctgargccagargatcgcttgagcctgggarttggaggctgcagtgagccttgattgcaccactgcagtctarcctgggagacagacagggagaccccatctcttttttaaaaaaaatgtagacaataaaaaatatataaagattggatttgatctcaagtcaagaggagtggtcatatgcaagagagtagatgccatgaaaatggtctgctgtcccaagtgtttttcccaattataaaactaacatatgtcttgtacaaattttgtaaaaattatacattttgtgaaaataggtaagcacaaagatcaaaagatgttttccaggaagaatcagatgggacatctccacctgatgtcactcgtggcaggcaaggggacgcttatccttgkgkggtggtctcctcctgggatggcgctgggtggngaggcccaccttttggaggcctttggggctytgacaagcttcaccctgsactatagctgncctggacngagggttgaata

SEQ ID NO: 3453 - DNA, 2160 bp, Homo sapiens
  misc_feature (773)..(773): n equals a,t,g, or c
gacggatcaccctccgctccaacatggctagtcctcaacgcgtgactcaagcctgttgtgccagcaggcgcactcagcagcgaccctcataggtggcgaaggtccgcgagagggttccgccagctagacagtggagtgccgcacagcgcgccttccagcctcgcagccgccaccctagcggttccgacccggcgccacaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgtctgtgctatgtgtgtgttaaaaatggatcatcactgcccttgggttaataactgcattggattttccaactacaaattcttccttcaattcttagcttactctgntctctactgcctgtacattgctacgacagtcttcagctatttcatcaaatactggagaggggaattacccagtgttcgctctaagttccatgtcctttttcttctctttgtggcctgcatgttttttgtcagccttgtgattctctttggttaccattgttggcttgtcagcagaaacaaaaccaccttagaggccttctgcactccagtgtttacaagtggcccagagaaaaatgggttcaaccttggcttcatcaagaatatccagcaggtgtttggagataagaagaagttctggttaatacctattggttccagccctggtgatggacactccttccctatgaggtctatgaatgagtcacagaacccactgctagcaaatgaagaaacctgggaagacaacgaggatgacaaccaagattatccagaaggctcatcatctcttgctgtggaaacggaaacatagcagttttcacatttcctgcatctctcagacagtattttcctaggggaaacactactactttggcatggtaacagatgttaaagggaagaaaaattatctggactcaccatctctgcctcccatgaggcttacagagttcaatgttggaaatcattgtaatcttcaaaataagtcaccgtgttggattgaaagcttcaaaatttgaaagaattccatcaaatacttgctgtgtaaatgtttctggactttatgttatttaatttactgrctgaaatccaatttggaatttggtagcagttaattmaagccaattttttttgkttcttcawttcccctcccccaatccatgaaagcctaatgtaaaatatatcttttcattcatcttatcaggtaaaaggaaattcagaaaatttccttagagtctttaattcccccacaaagattattaatcacatatatagggcctttttggtgttgaagggaatcaaactacatttgctgcttgtgtgcgtgtgcatttgtgaacacgtacagcatatctatacaaaattctgctatagtgtgaaaatcagggctaaaaacctgaagcctttgtttaattatgcttttcctctaaatagcaacttaaatatttgctagactttgaatcatcgctatatcaagtatctaaaatttgggagggtgaatcagtacactgtgaccaaggtcctcaaattggaatttgaacaacaatgtaaaacctgttctgtcacaaatgttcctgaaagcaccacagctactcaagaagatcaaattcaggacataaactttattgaacataataaccagtgttttttaaagacttttttgtcagggtgcagtaaaattctccaattacttttaaaaaaaaaaaaaaaaaaaaaaaaaaagggcggccgc

SEQ ID NO: 3454 - DNA, 829 bp, Homo sapiens
  misc_feature (758)..(758): n equals a,t,g, or c
  misc_feature (767)..(767): n equals a,t,g, or c
  misc_feature (793)..(793): n equals a,t,g, or c
  misc_feature (810)..(810): n equals a,t,g, or c
  misc_feature (814)..(814): n equals a,t,g, or c
gacaggggtgagccaccgccccaggcctctttcggcactgccctcaaccacatgggcctcactgttcttccggcgtacccagactttccccatctcagcgccttcccaccggtcctgtgtttccatggcctttccccgggtaggggcctttcttttcctagcttcgctcagttccctgctacattgtcgcctcctcgcagaagccgtctctggccgttccgtatcgctagcgccctctatcattcgctagcagctcacccggctctgtttttcttcattgcacttctcgttatgtgccgttctcttataaatgtttttgtctttatccctcccatagaagacacctccatgaaaggccagggctttccgaggttcttttcctctgtggttcctagaagagggcctggcacatagccggccttggctagctttttgcgtaaatgtgaagggatccaccttcctcccttataagaggtagcagtacctcctgttaccagcagagggcaccaccgtacagcacttgggggccgcagggatcctgctgggatgggaggtatttaaaaagcccacaggcctctcctcccataatgtgggcgctcccacagctgggaccggaagcaggaagggcccctgcgctaatctgccctggcagcagcgarctggcaagccctgggtgcatcatccggtgtgctctggtgcccaaagtcgggaatacctcamtggtggcttggaaaaaaccctgagcagtgatgcttctngacaattanaacctgttccggggtcttaaaatganggaatgacatgagctgnattntcgttaagcgttttg

SEQ ID NO: 3455 - DNA, 1495 bp, Homo sapiens
cgaagtgctgttttctaatgactctgtgcttggtcactttcctcaccagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaaggcaagtgtgggccatgccaggacagacagtggacgtgtatctgggaaggatgctgcagggcgtggtgctgagaggccagactctgcgtggaagagcgagctgacccctcgtgaccgccaaagcctagctggccatggggagtgaggaggaaagctgtgcccctcgaaaggaagccccgggcctgcccgcctctgaccacacacacgaaccctgcttttcctcccccagggcaggcagaacatctcaccggataagatcccgtggtctgcactaaagaccttaatggcccagtccatttatggcgggcgcgtggacaacgagtttgaccagcggctgctcaacaccttcctggagcgcctgttcacaaccaggagtttcgacagtgagtttaagctggcatgcaaggtcgacggacataaagacattcaaatgccagatggcatcaggtatgctgctgcctgctggaatggagacagttgtgatgtcagggcgtctggtgtcactcagaggtgacccctgacatcatttccaaatgcactggttttctaggcgagaggagtttgtgcagtgggtggagttgctccccgacacccagacgccctcctggctgggcctgcccaacaacgccgagagagtcctccttaccacacagggtaggcaacaaggatcctccccacacgcagggtgggtggcgagggtcccctcacgcggggtgggtggcgagggtccccacacgcagggtgagtgtgcactgctgtcccagggccctccctggttatgctgggtgtggctctgtcagcctcggccttcctgccagtctccagctgctcctagctccactccgaggggaggcagaggaaagaactggctcttctctgcagcatcaactcagttctagagaaaaggcttgatatttatgtaaatgagcctagaaataacatttagatgttcatctcatattgaaaagcagttactggctgggcacactggctcacacctataatcccagcactttgggaggccaaggcgggcagatcactcgaggttaggatttccagaccagcctggtcaacatggcaaaacctcgtctctactaaaaatacaaaaattaggtgagcatggtggcaggcacctgtaatcccagctactcaggaggctgaggcaggagaattatttgaacccgggagatggaggttgcagtgagctgagatcacaccattgcactccagcctgggtgacagagggagactccgtttcaaaaaaaaaaaaaaaaaa

SEQ ID NO: 3456 - DNA, 3244 bp, Homo sapiens
  misc_feature (30)..(30): n equals a,t,g, or c
  misc_feature (3242)..(3243): n equals a,t,g, or c
gcgccgcatcgctcgggtgcagcgcactcnagcgcacgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtactaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtgaaaaaaaaaaaaaaaaaaaaaaaaaaaaaaaaaaaaaaaaaaaaaaaaaaaaaaaaaaannc

SEQ ID NO: 3457 - DNA, 899 bp, Homo sapiens
ccacgcgtccggaaaaagtacaagcccctctcaaatggttcaagtttcaaatattagacccacccatggcaaagacagattttagtataatactcctaaaactacactgtcttttttttttttctgtcataagtgtgcattgtgctcagtcatttatttcagtgacccaaacagagcccagtccagctgtttgtattttccctgcagtgggaagtggactagggccatgtgactaagaaagccagcctgggggctgtcttttcacctacagatgttttaatgtgcttaacattatccaatactagcaaccgagatagtctaaataccacagcaggatctgattagctttttcagatcactgcctttatttgctgtttgcaaaaaagcttaatccagtgctagagatcaggcttcctgctgagccctggggtagtttctctcattctttgtgttcacagtggcaggcgttagtgagcagattcctcctcctcctaaattaaagctgtaaagtagtaactgtagtagcaagggataaagagaaggaagaaaacccaagggaaaaaagaagactgtctattcataccaagtagtttccttgatatacacaaaagaaagagtttctaatatgaattcataaatactgacctcagtgtctcttctactcagtgcacagctattaagttttattaggtttcagttgtaactactttgtgtggatatatgttacgtttttcatatttatcctactcaatcaatctcagttttaccagaagaattacatttattagccataacagtggcccttctcttattcttttcagggctgatatcttttttattcatgagatttcaaaaagaactatcaccaccactaacaaaaaaaaaaaaaaaaaaaaaaa

SEQ ID NO: 3458 - DNA, 1800 bp, Homo sapiens
tgcaggtaccggtccggaattcccgggtcgacccacgcgtccggccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggccaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcagctattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagktcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagtygactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttarccaactatactgatacctacagctacagaaagcaggactaggaactggaaataactttgggtcctgccttgattaggacgktctttttagaagcagttcttgcagctctggatcatagagwgacctttaataagttaaaaaaacgaggactgcttaattctgctagagttaaccttgagttcagagcagtattaaatgcgcgcactttcaggtg

SEQ ID NO: 3459 - DNA, 464 bp, Homo sapiens
  misc_feature (404)..(404): n equals a,t,g, or c
ttcctgccggaattcgggccggaattcccgggtcgacccacgcgtccgcatctgtcaggtgctcccttgccaatttgagacatgtggctcccagcctgggctgccatagaaaccttctccacttgctcctctctctctctctccttccagccccgctgggctctggcctcagagggatgtgcagggtcctatgtcaccacccacagggctctaggagcccacctttggcctctctggtctgaccagttcctggggaaaggtctggggttaaggatccctttcatcacccatgcacaccagtgatccaggttccacagatggacctgtgttccagcagcactgcctgargcatgttctagggatgcaaaactgaacagaaacacagagctgggkttgctcttgancttccttmaamccagctttcacccgtgttcttgcgtgaagtgcagtgtgtttgtatacgt

SEQ ID NO: 3460 - DNA, 1563 bp, Homo sapiens
  misc_feature (1449)..(1449): n equals a,t,g, or c
actagttctagatcgcgagcggccgccctttttttttttttttgttcgtccaagtgcactttccagtacacttaccatgttacgacttgtctcctctatataaatgcgtaggggttttagttaaatgtcctttgaagtatacttgaggagggtagaatcctgccccttcctccacatacaatgattatgaatcagaaccacaatttctaggaacgcagctgtatgcccaggaaaaaggaagagaagaaaacgaaacccaggaggggcatagtagctccaacaggtaaaggggtgagagcaagaaagaagggttaaaagaaatggtgcagcggacgtggaatagatacaataccaagtgtcaaccctggtctttcattgtgatggcaggagaggaaatggcatggggcgcacgtctgtggataatgtgtyagttattgttcttggcagccagtgagggcatcatgccacgcctgagagcgtctgcttggtgagttacaagtcatcttttcataagtcagttttgttttgtattccccaaaccctccagcagtttctcagaggaagagttcttccacaaaaaaatatttcataaatcctagactcttccctcattgtttccagccagcaagccctggagagctgctctcaggctcacttcagttcctgggtggggttacgtcactgtttttcagtagcgaactttctcagatgggacacacccaacctcacaggcacccaggagttctcgggtagcatgacccaggctctactcaagaagtgcggcccaatcccacaggctcgcaactcagactttctaagaatatgtcccaacaaatctcagtaaagggtctgagaattgkttatactcttttggctaatttttctataactgtgaaattatatcaaaattaaaaacataaaaacataacaaaatgcccaaataaacatagtgcaattaagagtgactgttcaggctgggagcggtggctcacgcccgtaatcccaacactttgggaggccaaggtgggtggatcacgaggtcaggagttcgagaccaacctggccaacatggtgaaaccccatctctacaaaaaatacaaaaattagcttagtgacggcctgtggactatgatttagacatacttaggtctaaaatcacacagctctgccacattctagctgcgtgaccagaggcaagttacttaacctctctgggcctcagttttctcattactgtaaaatgtgcaaaagaatatctacacaaccgttatgaagatataatataagccattattcaacaactatttattgagtgcctattggtgccaagcacttaaagctgtgagagacagttgtggaccccacctttctgcctttgcttggctgacagcctagtttaccttactccccaccccagccccacaagaggtttttgggtttttgkttggnttttttttttttttttttttttttttggtattacggatctctttaaaaaataaagaccttttaccaaaaacaaaaaaaaaaaaaaaaaaaaaaaaaaaaaaaaagggcggccgc

SEQ ID NO: 3461 - DNA, 576 bp, Homo sapiens
  misc_feature (12)..(12): n equals a,t,g, or c
  misc_feature (521)..(521): n equals a,t,g, or c
  misc_feature (535)..(535): n equals a,t,g, or c
  misc_feature (572)..(572): n equals a,t,g, or c
  misc_feature (576)..(576): n equals a,t,g, or c
aaattccccggntcgacccacgcgtccgggcaacattccgttacatagagaaatctatgtaataagctgtgtcataacacccatcagttgtatttatgatctttattaatgtattttgtttttaagatcttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttggtaagtatgtacttatttccacaataacagaacagacaaaaacatgatttaatgatgaagaccagatgaggagcagtataagtccaaagttagatgtgagtgatatgattcttgatagtattatccatagaaccctcttccctgagtaggcaatgatggggcttatctgagttggatatctggacttataagatgtggagagtcacatcktttttctttctttaaaaaaaaaaaaaanggcggccgctctanaggatccctcgagggcccaagcttacgcgtggcatgngacn

SEQ ID NO: 3462 - DNA, 2699 bp, Homo sapiens
  misc_feature (2699)..(2699): n equals a,t,g, or c
acaacaccagcattttaaaaatttctttttgtctgttcagacatgataacttttctgcccatcatattttccattctagtagtggttacatttgttattggaaattttgctaatggcttcatagcgttggtaaattccaccgagtgggtgaagagacaaaagatctcctttgctgaccaaattgtcactgctctggcggtctccagagttggtttgctctgggtgttattattaaattggtattcaactgtgttgaatccagctttttgtagtgtagaattaagaactactgcttataatatctgggcagtaaccggccatttcagcaactggcctgctactagcctcagcatattttatttgctcaagattgccaatttctccaaccttatttttcttcgcttaaagaggagagttaagagtgtcattctggtgatgctgttggggcctttgctatttttggcttgttatctttttgtggtaaacatgaatcagattgtatggacaaaagaatatgaaggaaacatgacttggaagatcaaattgaggcgtgcagtgtacctttcagatacgactgtaaccatgctagcaaacttagtaccctttactgtaaccctgctatcttttctgctgttagtctgttctctgtgtaaacatctcaagaagatgcacctccatggcaaaggatctcaagatcccagtaccaaggtccacataaaagttttgcaaactgtgatctccttcctcttgttatgtgccatttactttgtgtctgtaataatatcagtttggagttttaagaatctggaaaacaaacctgtcttcatgttctgccaagctattggattcagctatccttcaatccacccattcatcctgatttggggaaacaagaagctaaagcagacttttctttcagttttgcggcaagtgaggtactgggtgaaaggagagaagccttcatctccatagattcatgagaggggcattgtgtgtcttctagcagaaaacaaactggtggtgtatgaaacattttatatttcttactgtgttttctgtaatgtatgtgtatgaataatttccaaacatatacctagataaatctttaacctagtctaaaaaatgtatgtatgtgagtgtatgtgtgtgcgaaaaacttaagaacattgacaataacatgctcttttctgtttttttcatacaaactgccaaattatacaaaatatgacaaaaatttcttagaattttgaagccatgtatatttcattcatgttatatttcatttgtagaatttatgatgtctatttataattattaagaagtaacagtttatcccaggataaatattgctcttttctattgttatttgaaccacaggaatacaccacattgtgcttagaattcattgcttgaacctcgaatttattggatggtaaagtcattcaattctaaatcaataatgaggatgtatctttggtgttttattccattatgaatttctattttatgtttagtaaaaagcaatgagaattattgttagaaaacaatgcacacagtagaatttgagtgagaagcatatgcagagtaaatttaatgtatgtctaccataagcggtactgaggaatattagatttaaagcaagtatgtgaatagcttagaaaaaaatctctttgataataaagggaggaaatatcatgatcatggtcttgattgctattatcggtttccatatgcagttagaaacatcatttcttccagcttttgaattaaagaaaagctgtttttgaagttgagatctgatgtaaattattttagtatttttttctaaggcacttctaagcccctgaattgctaattatatcctcatcttccatttacaaaattccttctaaacttcagataagagaactcaaatcttctctttttgaaaaataaactatcaatgtaaatatagtatataaattgtggaaaatatttcagtcaaactttttgtaaatgttaaaatagtatctatgaaatctatgtattaattatgggatgtgccttaccattgtaattttgtcatcaatgatgaaatgaaagggtgttgacatattctttaataggaagttctattataagaaagaaatgtacagtcttgttcacagctaaattctacttgactgtattaattcttggtgttatgaaatttaaacaatgtgatttaatgttatttaaaccttaagataaatcatccccacacctgatttatgtaattttttaatcatatatcttcctcagtacaatgtaagaactgtaaagaaagagatcatgtctgacttgctttctgttgactcccaggacctagaacccagcaccaagaatagatggccaaaaatgatactttaatgaacaaataaatgggtggctaaaatggataagttgatgtggtaaatcaatgaaaaggaaactcatcacaaaatctgcagttgcatgaattcccctgttctggtctcaggttgaggttgcaggcttatccaagcagaatccttcctcagaggaaaagtttggctattccacaattttaggggaaatatcacactagtgatatatatagtgatatatagtcacactatatatatatatagtgatatatagtcttgatgcagctgtgtcaggtgtctgaattggagacaaggtaaaacatcaaaattagatgn

SEQ ID NO: 3463 - DNA, 1580 bp, Homo sapiens
cccacgcgtccgctttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3464 - DNA, 602 bp, Homo sapiens
agatgtactgctaccccggcagccacctggcccgggcgctgacgcgggcgctggcgctggccctggtgctggccctgctggtcgggccgttcctgagcggcctggcgggggcgatcccagcgccggggggccgctgggcgcgcgatgggccggtccctccagcctcccgcagccgctcggtgctcctggacgtctcggcgggccagctgcttatggtggacggacgccaccctgacgccgtggcctgggccaacctcaccaacgccatccgcgagactgggtgggccttcctggagctgggcacaagtggccaatacaatgacagcttgcaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgaggtaccaaagat

SEQ ID NO: 3465 - DNA, 1528 bp, Homo sapiens
  misc_feature (895)..(895): n equals a,t,g, or c
  misc_feature (1424)..(1424): n equals a,t,g, or c
  misc_feature (1502)..(1502): n equals a,t,g, or c
tattaggtacgcctgccggtaccggtccggaattcccgggtcgacccacgcgtccggtttatgaattcagaaattctgctcccagcaagcagacctcactatgattctctatatttgcctgcttctcaaaatttggggttgcagtttgccctgcaacttcagctttccattggacttaagaaaagtcatggattttcagtttgttcagcattttttcttataaaaacaagagtgatgactctcaagctctttaaattttggaactgaaactagaagcaacaggacattctgacatgaattatttaaaagggtcattgttgactctagagacattttaatattgctgcatcaaaagataaaagcattctcctttcttcttgtgtgatatatgccgtgtacacctctgagctcaccactaacctcaactctaccttatccctaacttcccatttcaaatggaagggaatggggatcaaggagtagaaggcctgttttacccattattgatgattaaaaagctgaaaataacccatcacaaaatggcctcagtaaagtggctgcatcagacatcatttagcctggaaaaccagtatgcataaaggctcawwtttaaatttttgaatccagtgttttttatttattattatttttttttttctgagacggagtctggctctgtcacctaggctggagtgcagtggcacgatcttggctcactgcaagctccacctcctgggttcatgccattctcctgcctcagcctcccgagtggctgggactacaggcgcccgccaccatgcccggctaattttttgtatttttggtagagacagggtttcaccgtgttggcgaggatggtctcgatctcctaacctcatgatccacccgcctcggnctcccaaagtgctgggattacaggtatgagccactgcgcccggccctgaatccagtattttttaatagaaacatgagttggttgagatactgagttcctgccttctccatcctaatcccaaatttccaatctttggaaatttgcccctttaccatttaatctcctgagcccagctcctctccagcctgaagagtgtgtctgtcaagactgtagctgtgaacaaaacactattacttgagccttatcctggagcaaatgtgtgtggtctcaccaatgaacatcagataagtcccttggcatggatttcttttcctttttagtaatacaatcataaaggttattcagacttattgagcatttactatggccagaaattgtgatacttgctttccatatagkttatctcacttactyctattaccctttgaagtcagaattctaactatgaatcagagaaaataagtgacctgsctaaggtcatccagttggkttatggtgaaggcaggatgcaaactgaaattgctgkganttgagtcggtgctttccctagtctcctcctctcagaggcagaacataagcatgtaatagataccactagggttcttgnttctaccttgggaacagctgtttgca

SEQ ID NO: 3466 - DNA, 1149 bp, Homo sapiens
  misc_feature (1120)..(1120): n equals a,t,g, or c
  misc_feature (1140)..(1140): n equals a,t,g, or c
gggtttctggggattggattcaaagagcagaagtatgatgccaggggctggtaaggactcagccatatagagatttcagctgcattataatgtatatttgagaaattgagttcttattatcagaaaattgacctatgtaatgaaatactagaagaaaactctaaattagaatggctttgttatgaatttttaatgataagtactaacacttaaaagggaaaaaatttttcaaagaaaatgcctaaaaatgtgttgtatctgagatcatcatatatgtagtattacagtgcaaacactattaatgttaatgaggtaggtggatttttttaatgaaaaaacttgaaatattatcaggttgtccccatttatggaatttaagcttgtcagaaagatccagatagctatattaatattttatctgtatttggttgcggttgcttttaaaaataagttttcttataagtcatttcaattttttggtttagagtccatatttcaaaataaaaagttaaaaaaagagtaccttatgtaatttagcaaggtattccataaactcagggaggaaaaaaaaaaaactaagatgagaggctagttataatgatctttatttatatattgcaggaaatgatttcctctctcacaacttagcataatttactgctaatatttttagccatgggttgaaaaaaattaartggttttgtaagtgctaatcctttgttactcatttaaactggtaaaatgtagtccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgaaaaaaaaaaaaaaaaaaangggsggccgctctaaggggntccaagctt

SEQ ID NO: 3467 - DNA, 1140 bp, Homo sapiens
cccacgcgtccgctgatgttattagcagcataaggcagtcatcgatgaggcttgagggggccttcttgtggggtcacggtcacctttccacagtacaggacttcgaacttctgagagttgtaaaaggcgtcctcattatctttgctgggtttggcatcctctttcatggccgmtttagataattgccttatgctgctaataacatcaggaacctggctggggtctgtggcgcggaaaacgtggcaggccatctgcgactcggggtcgtcgggctgcgccttgatcaggtaggcaaagtaggtgaggtcgtggctgttgtggatgaagcgcgagatatgctgcgccttgtgctcgaagatgaataccgccgggttgggctgcgtggccgacggactagtgccccccgaggccccagcgcccggcgcggggacgcaacgcaggaagggcgcgctgagcaccaggatcacctctcgggccgccggcgccccgcagccgcccgcctcgggcttctggctgcgcctgcggatctcggccatgagccagggcagcataggcagcgtggtcctgtggtccaggcacgaccccccaacgtaccacagccggaaccgcttatcgcttggcttcccggggccgggctgagctgagacgcccggctcgggctccagggggtgcgggaacggctcatcctgaatgcagctgggcggctycataactctcgcctcaccagggcaccgcggaggccggccgggcgcaccgcgccccccactcccgcgcagaaggcgccgccgaaactgtgccaactgccgcaccgggctyccgcgcctgcctgggagcggcgcgaccccgaactccgcgcttcagcagccctgccccatgcagcacttccacgggcgcggctcggaggctccggcggcgggcaccgaggcaagcgcccggcaggcgagggcgggttaaatgggcatcctcctcctcgggctggcgcctcgggcaggacctccccttcctccgtcgcgggtttgcagggtcagaggaccacgccgagggtccccgcggccgctctagaggatccctcgaggggcccaagcttasgcgtgcatgsgacgtcatagctaatctccctatagggagttgcaaaagggt

SEQ ID NO: 3468 - DNA, 1012 bp, Homo sapiens
tcgacccacgcgtccgctcttatgcagccttaagtttgtctgtccatggttcccatctttgctttatatccctggtcttaccacgctcttctgaagtacccatcctttccttcaaatacttttaggaaaaaggtctgataatagtgatttataatgtagttggatttaagtcgttgttttacgtctcaagaggcatttacattttgacttttcctataaatgtgaatgaaaagatacctctttcaaaaaatttagagcttccctgtgcaagtgttggaggtctcagggaggagagttctccctgctggttcttttgaatcacaccaaatgaatggcttgctactgttccctcacaccttcatattgtccatggtttttcccacctccttagctatacagctgctgttcctcctgcctaaaatgtctgaacattccctcagtgttcagctcagcccacatcttacatcttccctaaggatgtttttctgctgctatcattcattttcttcctatgagttcctctgttatattgcgtcaccatcactgaggttggcatttcttcattctttgtttcaattgactcatttcctttctcccaacttagtgtcttcttcaagaacactgatcctgtatttctgttttctatttaaacagtgcctagcaaagagacaggaatggcagtcaatgaatacccaaatagacatgagaatatgtctaggcccatgtatatttatgtatattttatctagcagcattttgctaaatgaatttatccttcattagaagaagaaaacatatcatacttaaggaccattattaaaaattcttaaaagtaaaaaaatagacctgtctgggcacagtggcacatgcccgtaatctcattactttgggaggctgaggtgggaggactgcttgaggccaggagtttaaggccagcccagataacatagtaagaccccatctctaaaatcaaaaaagaaattaaaaaaaaaaaaaaaaaaaaaaaaagggc

SEQ ID NO: 3469 - DNA, 3455 bp, Homo sapiens
ccacgcgtccgcggacgcgtgggattgcttctctgatgattttcttcactctttatgactctccccacttcacagtgtctaatttgtctgctgcaggctctgtgtggcattgggcatggagccttggcttggggcagtaaccaagtgttgtttccagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatggtaatcgggtcatcaagagttgtgtctgtggggagtgtgtgtgtccgtgtgtgtgtacatgtgtgtatgtgcttgcagacccaaggaggtcctgatatggacagttaggccagtaatgatacttctgaatgtctggactctattttagtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggttggtttatgctacaataaaatctatcttctccttggccatccagtaaataacagcatgctaagataatatcttcttttacttaaatatgcaaacttgtatccagtgaaggcctgggctggccactaggttaaagaccaagggctcctcaggacaagagaaaacgtatttattgtttgttacccatgaagctagcagtgccttcttttaaaatagctctgaaatttttgttacctagaaggaaattagtcaaaccggatccacttccaatggagagaacagttcatggtagcagtctcttaaactgagtttaattctcgacaacataaagtcagggacccttttgggattaaagagggctcctcaataaacaagaggtgctttggagagaatgagtcctctcatgtgtggtccacgatgctaatctgtgaagactgcaaatctttgagaaactgtgaggcctatccctgtgtttgggaaggagttgagcagctaagagtctgaatgaagaggctgtttcagggagacttcagaactttcacagaatgcacttgcaggcactgggggtgcgggtgggggaagctgggagtgcctgatgtgctgtgaataaacgaagcccaaacacatttatctaaatcaatgagttaatgcagattgctgctgcttttttttttaaatcaatattattcttttagatgctaatttaaagatccattatgcctgagatgcccaggcactggttagaattaatgacgtactagtgtttagctagaatgaaggtgaggaagcagaggtggaagtcagcctggggaatgtttgcttctcatgctatgggtccagactgtgcacgttagaattgtgtggggatctttaataaattctgatgcctggttacaaccacccgactttctaatttaattggtatggagtgtgacccaggccaggggatttaaaaaattccccaggtgattttactgtgaagcaaagtttgagaaccactctgctgatggcttcctttaatttaacaaacagtggaaacctgtgtgttggggaaggcaactatcttattcatatgtgtcttcaacactcagaataatcctgataattctaaaatttattcagttagatcaagaaatataaatatacattcttaagagaataaacccacaagaagtgactgtatgaaaacatgcatgggaaagtttcagctagtgaaatagtacgaggtgaccggagtcttgattctgagcctgcatggggtgtgagctattagtaacatcagccataagtgctggctgggtgcagaggatatgaatgcccgtggttgatgttcctggttcaaacttttcacatccagctgggtagcggcttatgttggaaaccctcttttgtgaccaatttaattgtgagtagagcagatctggttcaaatctcagctgtgtccactgttaactctgaaacctaagcaagttattgcccatctctaatgctcacccagcttttgtgagttgctttctgtggtttttcttattgttctgagtcggcgtggcagcagctcaccaagaccacggagaattgaaagccagtagttcagaggaaaggagcaataaaaacactttctgctgatcaggtacctaccatgttccagacatggaactgggatcttcatatacagtgttttaaatcccgccagagatcttcaaggaaccactatcctcagtgttcataggaggctcataaagttaaatagttcatcccaaattacatgtattcatagtgctggagctaggatttgaatccatccaggtcatctgcctccaaagcactattctctatgccacaggtaaggtttaggccagggattcccatgtgttttcaacaatggaccacatgctcagaagtccttgtgtgtgccagccctgtgagcgtggttgataaaactgatggcagattcagagggtcaacaccacacacatgtaaattagatagagctcaaaagttagtaaaagacatatggcgatgttgtgcaggccaatttgccccactctccttacgatccatggtatttcataatgctccaatttgatggcacaagtggaattaaatgaacagcttgtattgaatgacatgctctcttggccactgtgaatgccacttatgctaatgaagcccctggagtgtccaggagggcaggggactctgccatttatatccccaatgtctggaacaatggctgccacacagaaagtgctcaaatatctactgtctgaatgaatgaatgaatgaatatggctgggtgcaatggtgcatgcctgtaatcccagcactttaggaggctgaggtgagaggatctctcaagcctaggagttcaagaccaggctggggaacatagtgagaccctgtctcgacaaaaaattaaaaaaaaaaaaaaaa

SEQ ID NO: 3470 - DNA, 1796 bp, Homo sapiens
ggaaggaggaagttcaagggcgagartragtaccagcagaaggctgggagtctgtagtttgttcctgctgccaggctccactgaggggaacggggacctgtctgaagagaagatgcccctgctgacactctacctgctcctcttctggctctcaggctactccattgccactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacaggcacaagctcctgaagctcagtgtcctcctgcccctcatcttcaccatattkytgytgcttttggtggccgcctcactcttggcttggaggatgatgaagtaccagcagaaagcagccgggatgtccccagagcaggtactgcagcccctggagggcgacctctgctatgcagacctgaccctgcagctggccggaacctccccgcgaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccamctcagtagccamctycccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctctacatagttgaggagggggctagggatatgctctggggctttcatgggaatgatgaagatgataatgagaaaaatgttatcattattatcatgaagtaccattatcataatacaatgaacctttatttattgcctaccacatgttatgggctgaataatggcccccaaagatatctgtgtcctaatcctcagaacttgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatgaaaaaaaaaaaaaaaaaaaaaaaagggcggccgc

SEQ ID NO: 3471 - DNA, 1264 bp, Homo sapiens
  misc_feature (1)..(1): n equals a,t,g, or c
ntagaaccctgcttctcatataagatgggcctgcacctacctctggcatgtttttctttgtgtatttcctgtttttcatcctgtaactaatgctcattatttaaaacactccagttacttttccctttaggcctggcaaacttttctttttcttttttttttttataactgtacattttacaaaacacctgaaaggacccagaggcataaatagtattacatgatttatggtagctctggggtgagctgtgggggaggccagttacaaggtctccaagacccgcctccatgtcagtgttggggggtgccttgagcacttcttttatttcatataggaaaatgcacatctttcatttgtctcccaaaagatgatttccataaaaatatacttcaaagtatttactgtacatagacttcaatgattttatttccagcatcaaactaaacatttctaaccttttaaataaatggggaatttagtttcatgagaatttttactgacaactaataaacactgtatgtgtacatattcatatacactgtggactggagaaagtcagtatggaaataaatttcactgagatccagaaagtagcaatataggacttttaggggtatgtattagtgtaaataatatatgtgcagtctaggctaatcattttaattaaaaacaaataagcatacttttttgctttaaaaatatgccctcaaaatggtgggggataaaatgtaagatattctttagctttaattatttttccatcttattcaagtcagagcacttttttttaaatagcaatacaacaggcaagagaatactcaaaaatatttaaaactgtattgataccaagagtatgttttaaatattttctaataaatacttgagcggtttttgtctggcaggcttccaaatttgccaaaattaagcgttcagtattttcaacacatacgctttttactggtttatactgaactatctgatgagaattcctgtgttcccaaagcaactgatgtttacaggtcttgtgtttctcctcctcctttctaaggatgagggaatccacaacagactttctctagaaaacactaatgatggacaactttttggtgtcatcaatgagttggctactaccttgatgtaaaaatttgtaaggaaaattttcaccatttcgagtgtcaagtgtatttttaactgtctggtttgtacttttatgacttttgtactaccaaagcggagttaaaaataaaaatgttaaacgcccaa

SEQ ID NO: 3472 - DNA, 892 bp, Homo sapiens
  misc_feature (327)..(327): n equals a,t,g, or c
gccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggsgcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggnacagtcacaccccagcagcagtgagtgggcaggtttggaggagcagccagggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcwmaaaaaaaaaaaaaaaaaaaaaaaaaaaaaaaaaaaaaaaaaaagggcggccgc

SEQ ID NO: 3473 - DNA, 1773 bp, Homo sapiens
  misc_feature (538)..(538): n equals a,t,g, or c
taaatgctttcaccggtccggaattcccgggtcgacccacgcgtccgcagggggttgcctggtctgcccagctggtggggagctgggtgatgctgcacatatggctctaccgtgccttgctggagacccccagacgcgttcctttactcccgcagtgtgagcaggcggccaggtggctggtgtgggccagcatgcaggctggcaaaggcctggctcaggtgtggggcgtggcaacctttgtgcagctgtgtgcccacacggtcttcctgagcatgtacctgtgcatgcacatctgctttgccgccatcagctctaaggtccgtgtgagagtgaacgcaccgttctgtgtctcagtgcccttgaaggtccatgcccctctgagcctgggcatcaaagtggggctgcagggccagaagcatgggagagccacgggggaggcaggtatgcctcagggggagatgttgkkgaagcaggaaccccagacgtccagcagccccaagcccaccaggagaagggaggtgtcacggaktgagctcantccagtgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaaaaaaaaaaaatgccccccgggggggg

SEQ ID NO: 3474 - DNA, 2670 bp, Homo sapiens
  misc_feature (2664)..(2664): n equals a,t,g, or c
aattcccgggtcgacccacgcgtccggcagcatgctgtgtgccctgctcctcctgcccagcctcctgggggccaccagggccagccccacctcaggcccccaggagtgtgcaaagggctccacggtgtggtgtcaggatctgcagacagctgccaggtgcggggctgtggggtactgccaaggggccgtatggaacaaacccaccgcgaagtctctgccctgcgacgtatgccaggacatagcagccgccgctggcaatgggctgaaccctgacgccacggagtctgacatcctggctttggtgatgaagacctgtgagtggctccccagccaggagtcttcagccggatgcaagtggatggtggatgcccacagttcggccatcctgagcatgctccgtggggccccggacagtgccccggcacaggtgtgcacagcgctcagcctctgtgagccgctgcagaggcacctggccaccctgaggccactctccaaagaggacacctttgaggctgtggctccgttcatggccaatgggccccttaccttccacccccgccaggcgcctgaaggagctctgtgccaagactgtgtacggcaggtctcccgactccaggaggctgtccggtccaacttgaccttggccgacttgaacatccaggagcagtgtgagtccttggggcctggcctggccgtcctctgcaagaactacctcttccagttttttgtccctgctgaccaagcactgaggcttctccccccgcaggagctctgcaggaaggggggattctgtgaggagctaggggcacctgcccgtttgactcaagtagtggccatggacggggtcccctccctggagctggggttgccaaggaaacagagcgagatgcagatgaaggccggtgtgacctgtgaggtgtgcatgaacgtggtgcagaagctggaccactggctcatgtccaacagctctgagctcatgatcacccatgccctggagcgcgtgtgctcggtaatgcctgcctctatcacgaaggagtgcatcatcttggtggacacctacagcccctccttggtgcagcttgtggccaaaatcaccccagagaaggtgtgcaagttcatccgtctgtgtggcaaccggaggcgggcccgggcagtccatgatgcctatgccatcgtgccgtccccagagtgggatgcggagaaccagggcagcttctgcaatgggtgcaagaggctgctcacggtgtcctcccacaacctggagagcaagagcaccaagcgagacatcctggtggccttcaagggtggctgcagcatcctgccgctgccctatatgatccagtgcaagcacttcgtcacccagtacgagcccgtgctcattgagagtctcaaggacatgatggaccccgtggctgtgtgcaagaaggtgggggcctgccacggccccaggaccccactgctgggcaccgaccagtgtgccctgggcccaagcttctggtgcaggagccaggaggccgcaagctgtgcaacgctgtgcaacactgccagaagcatgtatggaaagagatgcacctccacgctggggaacacgcgtgaccgtggctgccagagacccagagcctgttagcgaggcccatgaggtgggtgctttccccatccccatttcacaaatgaaaaactgaagctctgaggagggaggctgggaaggagcagagctgaagttcaaaaccaagtattcctgatcccgaaagcctctctcttaacaacggtgccgcacagctttgcccttgaaagcatctctactggaccggaacacactcatgtgccccgctccctgacccagccaaggctgccctttcatctccaaggctgagatgttgccggtggtcccatgagagcctgcccatgggctcaggtgcccctttaccttctgctggatggacatctggctgtgagccaggctggggtcatggccggggtgagcggaggcaggggtggacggaggcttcgagggcccatcactagtagggtcattacctcttgccaacagccgggggtgggagtctgggtctcgctcaggccagagcttctcaacctggagtccctgggggtggctgccaaaggtgtgtatgacaagcacgtatccctggacatttccggggagaggtctggggctttggtcacattctccaagggctgctgggcttcggagcagtccccccccatgtctcagccactacagggtccctctctctccttgcaccccagaccctccgctgccctggtaatgagcagaaggaaagtcttggggtgtgctcaaagtcaggagagcaaaatatgccaggcaaaagctcccgggaaaagcctgaggagtctggggtggccaccgggatgtggagcagcgagggcaaagacggtgaacacagccctccagctgtctgagcctcagttttctaatctgtagaatggggatgatcatacctgcctcacaagaatgttgagacaattcacagagacgttctggagcccctttcccccgagaccggcattcatgagtctgctgggaccagaaaacccatctcaggggcccagcggggcacccaggagagtctggcggtgcaagcgctgtataaaccacaagcgttctccaaaaaaaaaaaaaanaaaaaa

SEQ ID NO: 3475 - DNA, 2513 bp, Homo sapiens
gggtcgacccacgcgtccggggtgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaaaaaaaaaaaaaaaaaa

SEQ ID NO: 3476 - DNA, 1290 bp, Homo sapiens
ccacgcgtccggtcagcggctcggctcccgcgcacgctccggccgtcgcgcacctcggcacctgcaggtccgtgcgtcccgcggctggcgcccctgactccgtcccggccagggagggccatgatttccctcccggggcccctggtgaccaacttgctgcggtttttgttcctggggctgagtgccctcgatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgaaaaaaaaaaaaaaaaaaaaaaaa

SEQ ID NO: 3477 - DNA, 2616 bp, Homo sapiens
aattcccgggtcgacccacgcgtccgcggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggcaagtaggcttggcatgggcaggtgcagatgtgctgtgtgggcacccagtgcccaagaggccaccaaccttgggtccccaaacctccggggctgactggcacctgcgaggacactcacccacccaccttttacagtgacggctcagggctgtagtcccagctactctggaggctgaggcaggagaatggcgtgaacctgggaggtggagcttgcagtgagccgagatcacgccactgcactccagcctgggtgacagagcgagattctgtctcaaaaaaaaaaattactttgaaataggccgggtgcggtggctcacgactgtaatcccagcacttcgggaagccgaggcaggtggatcacctgaggtcagaagtttgagaccagcctgaccaacccggtgaaaccctgtctctacttaaaaatacaaaaattagccggatgtggtggcgggtgccagtaatcccagctactcgggagactgaggcaggagaatcacttgaacctgggaggcagaggttgtagtgagccaagatcgcaccattgcactccagcctgggcaacagagcgagacttcatctcaaaaaaaaaaaaaaa

SEQ ID NO: 3478 - DNA, 1151 bp, Homo sapiens
ccacgcgtccgcggccctgcgccccagccaggcctgaggacatgaggcggccggcggcggtgccgctcctgctgctgctgtgttttgggtctcagagggccaaggcagcaacagcctgtggtcgccccaggatgctgaaccgaatggtgggcgggcaggacacgcaggagggcgagtggccctggcaagtcagcatccagcgcaacggaagccacttctgcgggggcagcctcatcgcggagcagtgggtcctgacggctgcgcactgcttccgcaacacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgaaaaaaaaaaaaaaaaaaaaaaaaaaaaaaaaaaaaaaaaaagg

SEQ ID NO: 3479 - DNA, 1068 bp, Homo sapiens
tcgacccacgcgtccggccctggagacactttgactgtggacttcaggcctccagagctgaaggagaatgaacacccactttggggtcacgtgttacagaagctgcaggaggatcccgcaatggccagcatggcacacgcctcagggcctcagtttccccagctgtgaaatgaggatgatgacaggacctgcctcacaggcttgcagtgaggataaaatgagttgatatgcatggaatgcacgcagcagggaccggcacggaactgacattgagtggatgtcagcctctgtcaacattactattactattactgtattattgcccttcgttcgttcattccataaatatgtgcaaagcggctgctctgagccttccgtgggcagcagggcagcacagaggaggcctgagcggtggtgctggggagaggatggcgtagggcaggcctcgtggacgcagccgggggcctcaccatcagcataagcgaccacggtgggcttcagaaggagcgatgagacaggattcaccccattgccatttgcttttctatcggatcaggaagaagcatgggatgaagctggggtgtcaaggagggtctcccttcctcggtggtcacctgaggtgctggggccccacctttaactctctctgctggacctggaagctttgcccaggtccctgggaccgtcgcgttcacaggcttccaccgaggctctcgctgggtacattgacttgacccacttcagattttgttttcttaaaactcatccccaagtacactttgggaggccgaggcaggcagatcgcctgaggtcaggagttccagaccagcctggccaacatggtgaaaccccgtctctactaaaaatacagaaattagctaggcgtggtggtgcatgcctgtaatcccagctactcaggaggctgaggtaggagaatcgcttgaactcaggaggtggaggttgcagtgagctgagaacgcgccactgcattccagcctgggaaacaagagtgagactccatctcaaaaaagaacaaaaaaatgattaaaaaccaaaaaaaaaaaaaaa

SEQ ID NO: 3480 - DNA, 1282 bp, Homo sapiens
  misc_feature (1231)..(1231): n equals a,t,g, or c
gagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggctaaagggtattgaagctgcagagggatcaacttgtgcttgccagaggacgccaatgaagtttgaaacaccaacaatcagagattttgtttctgttcctcattaaatcatgagcttttgtgccgagaaaaaaaaaaaaaaaaaaaagggcggccgctctagaggatccctcgaggggccncaagttacgcgtgcatgcgacgtcatagctctctccctatagtgagtmgta

SEQ ID NO: 3481 - DNA, 2604 bp, Homo sapiens
ccgggtcgacccacgcgtccgcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtcttacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatccacagacctttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcaaaaaaaaaaaaaaaaaaaaaaaaaaaaaaaaaaaaaaaaaaaa

SEQ ID NO: 3482 - DNA, 1938 bp, Homo sapiens
  misc_feature (1938)..(1938): n equals a,t,g, or c
ggcttccccttcgtcttcctcctgggcctcctgccccaggtcaacacctgcctcatgtacctgctggagcaaatagatatgcacggcttcgggggcacagctgccaccagcccgctcacggcagtcttcagcctctcccgcagcctgctggctgctgccctgctctacggtttctgccttggggccatcaagactccgtggccagagcagcacgtccctgtcctcttctcagtcttctgtggccttctggtggcactgtcctaccacctgagccggcagagcagcgaccccaccgtgctctggtctctgatccggagcaagctgttccctgagctggaggagcgcagcttggagacagcccgggccgagcccccggaccccttgccggacaagatgcgccagtcggtgcgtgaggtcttgcactccgacctggtgatgtgtgtggtgatcgccgtgctcaccttcgccatcagcgccagcaccgtctttattgccctgaagtcggtgctgggtttcgtgttgtacgcactggctggggccgtgggcttcttcacacattacctgctgccacaactccgcaaacagctgccctggttctgcctgtcacagcccgtgctgaagccgctggagtacagccagtatgaagtgcgcggtgccgcccaggtgatgtggtttgagaagctgtatgctggcctgcagtgcgtagagaagtacctcatctaccccgccgtggtgctcaacgccctcacggtggacgcccacacagtcgtcagccacccggacaagtactgcttctactgccgggcgctgctgatgaccgtggctgggctgaagctgctgcgctcagccttctgctgccccccacagcagtacctgacgttggccttcaccgtcctgctcttccactttgactacccgcgcctctcccagggctttctgcttgactacttcctcatgtccctgctttgcagcaagctgtgggacttgctgtacaagctgcgtttcgtgctgacctacatcgcgccctggcagatcacctggggctcggctttccacgcttttgcccagccgtttgccgtgccacactcggccatgctgttcgtccaggccctgctctcggggctcttctccacgcctctcaacccactgytaggcagtgccgtcttcatcatgtcctacgctcggcccctcaagttctgggagcgcgactacaacactaaacgtgtggatcattccaacacccgcctggtcacacagctggacaggaaccctggcgctgatgacaacaacctcaactccatcttctatgagcacttgacacgttcgctgcagcacacactgtgtggggacctggtgctgggccgctggggcaactatggccctggtgactgcttcgtcctggcctctgactacctcaacgccctggtgcacctcatcgaggttggcaatggcctcgtcaccttccagctgcgtggccttgagttccggggcacttactgccagcagcgcgaggtggaggctatcaccgagggtgtggaggaggacgagggctgttgctgctgtgaacctggccacctgccacgggtcctgtccttcaatgctgcctttgggcarcgctggctggcttgggaggtaacagccagcaagtacgtgctggagggctatagcattagtgacaataatgctgcctccatgctgcargttttcgacctycgcaagatcctcatcacctactatgtcaaggtacggtgggcaggtgtggccgggcagcagggcccttgcgggtgagcgctcgctgaccagaggccccagtaccccctttctgggttgttgggagcctgttttgtccaagggaagctgaggcctcagagagtttaagtgtcccctgaggtgccactgccagacctcaggttgcaggggcctctgtgcccatakctn

SEQ ID NO: 3483 - DNA, 1786 bp, Homo sapiens
tgcaggttcagatgtgtataagagacagggtctatataagcagagctcgtttagtgaaccgtcagatcgcctggagacgccatccacgctgttttgacctccatagaagacaccgggaccgatccagcctccggactctagcmtaggccgcgggacggataacaatttcacacaggaaacagctatgaccactaggcttttgcaaaaagctatttaggtgacactatagaaggtacgcctgcaggtaccggtccggaattcccgggtcgacccacgcgtccgatgaagccggccactgcctctgctctgctcctgctcctgctgggcctggcctggacccaggggagccacggctggggtgcggacgcgtcatcactgcagaaacgtgcaggcagagccgatcaggtgagtctctgtcctcaagttaccctgcagggcccttggtcccccttggccttgctcccgggtctgggcaatctgaaattctctttcactcctccattcaatggctttctcagccgggtgcaggatggcaggaggtggcagctgtaacttccaaggtgagacatctaccatggatccgctgggttacgtcctggcacttcttttcttggtctcctaccctcacctcccaagtaacacttgaagagttggcagaggtcttgagggcaggaggaggagtaggaggaggaggcggcggccatttgggctaggacagtaaaggcaggtgagggtgggggccctggctggctggaggagattgtataaaagaaaacacgtgacacaaggaggggagcaggcaggtgttttaggaaaggtctggtccaggcaggaaggtgggatgtttattccagagcaaaatggccttcgtccgtctgttctaaccgccatgcccactttcttccacagaactacaattacaaccagcatgcgtatcccactgcctatggtgggaagtactcagtcaagacccctgcaaaggtgagaccggcaaccaccctgtcttcccgctgggggctctgcatgagggatggggagagaggctttcactgccggggtcctctcggttggttgccggaggccggatcccgctctctttgagtccaggcctccccacccctttgcaagggagactcgggttccctgagacagtttggaagtggagggcaggagggttcaatgcgcctcacacccacccagtcagaaaaggttaaaaaggagcagcagcagcaacagagaaaactgagaaccaacaccctctccaagaagaatataggctttaaaaaatcatgacacctgcaaaacacgcaagcagctcttcctcacaggttccctctctgtggacctttttttgcgggggaagatggaatggagggcgaggaaagcagactagcacttaggggaggccggcctgtggatgcctggttggcggtgaaatgaatgctttattccacaaaggaaatgaaaagaaaaaatacgtgagaatttggttttattccgttgcaaagaaggcaatctcataacatcagtaaatgaatatgctaagtacaaatttggctgacaaagcaacagcaggctgtgtatttccatctctcatgacaataaagtccccgcccttggggagaggaccttccactgagggacgagaaactacaggctggtgagaggagggacgtgcagcttctactgcctgtggcttccactctgctgagttatctgtggcttccactctgccgggttatctgtggtcctgtctcttatacacatctcaacctgcaggggggtc

SEQ ID NO: 3484 - DNA, 4631 bp, Homo sapiens
ccacgcgtccggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccagccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccacaatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggaggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctacattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacggcttgcccctgtctttgcccccaaaggtattttgtgtctagtgtcacattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgttgagaaaaaaaaaaaaaaaaaaaaaaaaagg

SEQ ID NO: 3485 - DNA, 644 bp, Homo sapiens
  misc_feature (538)..(538): n equals a,t,g, or c
  misc_feature (550)..(550): n equals a,t,g, or c
gcctggagccccttcgccaggcggctttcactgacggtgctggccagggcagcagggccggtttggcgacctggaggtggatatgggtagtggctgcccagcccagccaaccctgtccccttggggcattctctcgaggctgctgggtgtcctggcaggcacgtcctgtggggtcagcacgccggctgcagcgcagggtgggcctgagatcgggtgccgggccccccatctccacctgtctggacacgcacccctggcctgtccttgcagcttcctcccgacatcccttggcggtgtctgtgtctcggccccagccccagccctcctttcctggggcaccctcccagccatctggtattggggctgcccccattgcctagtcctgggcccagggccagcccactctgggctggctttacttgtctgttcctaatggcagggcgtcccaggaacagccccataagagctggtagaaacaggagggagtccttgtcagcaggcatcttcgagctttttgttttgttttgtaaaaagcggntaaccagcaagntacataaaagcttatttgttcccactgaattttccacacctcacacgtgagtcccagccattgcagtgcttgtgagggagcatcacccttgccg

SEQ ID NO: 3486 - DNA, 2142 bp, Homo sapiens
aattcccgggtcgacccacgcgtccgcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggattctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccaactgtctgacacttgtcaacacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaaaaaaaaaaaaaaaaaaa

SEQ ID NO: 3487 - DNA, 950 bp, Homo sapiens
cccacgcgtccggggtcaaccacgagagctggcgtgacagtggccagactgacggcctgacctttggccacctgaagatggtgctgctgtgggcctctgtgctcttcccggcgcccgaggactgggcagagctgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttcaacatccaggataaggaccggatctctgccatgcagagcatcttccagaagaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgatgaaatgctgtatatttggttttgaaaaaatgaatgtgctgggtatacacagcagaaagggaaaaaaaaaaaaaaa

SEQ ID NO: 3488 - DNA, 1055 bp, Homo sapiens
ccacgcgtccgggcctcctccactgggtccgaatcagtaggtgaccccgcccctggattctggaagacctcaccatgggacgcccccgacctcgtgcggccaagacgtggatgttcctgctcttgctggggggagcctgggcagcgtgtggaagcctggacctcctcactaagttgtatgcggagaacttgccgtgtgtccatttgaacccacagtggccttcccagccctcgcactgccccagagggtggcgatccaaccctctccctcctgctgcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttcccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttcaaaaaaaaaaaaa

SEQ ID NO: 3489 - DNA, 1350 bp, Homo sapiens
  misc_feature (1135)..(1135): n equals a,t,g, or c
  misc_feature (1148)..(1148): n equals a,t,g, or c
  misc_feature (1166)..(1166): n equals a,t,g, or c
  misc_feature (1174)..(1174): n equals a,t,g, or c
  misc_feature (1181)..(1181): n equals a,t,g, or c
  misc_feature (1209)..(1209): n equals a,t,g, or c
  misc_feature (1229)..(1229): n equals a,t,g, or c
  misc_feature (1266)..(1266): n equals a,t,g, or c
  misc_feature (1285)..(1285): n equals a,t,g, or c
  misc_feature (1287)..(1287): n equals a,t,g, or c
  misc_feature (1290)..(1290): n equals a,t,g, or c
  misc_feature (1295)..(1295): n equals a,t,g, or c
  misc_feature (1305)..(1305): n equals a,t,g, or c
  misc_feature (1324)..(1324): n equals a,t,g, or c
  misc_feature (1339)..(1339): n equals a,t,g, or c
  misc_feature (1341)..(1341): n equals a,t,g, or c
  misc_feature (1343)..(1343): n equals a,t,g, or c
  misc_feature (1345)..(1345): n equals a,t,g, or c
  misc_feature (1348)..(1348): n equals a,t,g, or c
ccgggtcgacccacgcgtccgcggacgcgtggggtttgagagcctgaaatccgacttcaacaagtactgggtcccctgcgtctggttcaccaacctggcggcccaggcccggagggacgggcgaatacgtgacgatatcgctctctgtctacttttggaagagctgaacaagtaccgagccaagtgcagcatgctattccactatgactggatcagcatccccctcgtctacacccaagtggtgaccatagccgtctactctttctttgccctctccctggttggccgccagtttgtggagccagaggcaggggctgccaaacctcagaagcttctgaagccaggccaggagccagccccagccctgggagacccggacatgtacgtgcctctcaccactctgctgcagttcttcttctatgctggctggctcaaggtggctgaacagatcatcaacccatttggtgaggatgatgacgactttgagacaaatcagctcatagaccgcaacttgcaggtgtccctgctatccgtggacgaaatgtaccagaaccttccccccgctgagaaggaccagtactgggatgaggaccagccgcagccaccctacactgtggccacggcggccgagtctctgcggccctcattcctgggctccaccttcaacctgcgcatgagcgacgaccctgagcagagcctgcaggtggaggcgtcccccggatctggtcggcccgcgcccgccgcgcagaccccgttgctcggccgcttcctgggcgtaggggcgccctccccggccatcagcctccggaacttcggccgcgtgcgaggcaccccccgccccccgcatctgctgcgcttccgggcggaggagggcggcgaccccgaggccgcagcccgcatcgaggaggaatcggcggagtccggggacgaggccctggagccctgagcttttacaagccttgttccatggtgagaacggtcatctgtgaaggtggtagaaatggagaatggatggatttcaagactttagagaaagaacccactggttttatggacagatcttggctcactgcaacctccacctccccaggttcaagagattctcatgcctcagcctctcaagtagctgggattncaggcacatgccnccacaccctgctaatttnttgtatgnttagtanagatggggtttcaccatgttggccaggntggtttttgaactcctgacntcaagtgatccacctgcttcggcctcccaaagtgctnggattacaggcgtaagccncnatncctgnccaaccttcnaatttaataaagtctcaanacttttttcccaagnanananaanaa

SEQ ID NO: 3490 - DNA, 2148 bp, Homo sapiens
ccacgcgtccgcaggcctagcagcctccctcgggctccctctgttcctgagctccgagtgtggcccacctgctccacgctgtttcctgtaactccggcccgtggctgcctctcttctccaactgcaagtctgctccgtccccacccctgctggtgctgtgatgggtgtggccctgccctctcccctcctgtgttctctgcctctgttcctcctctttggggatgtttcaggctcctcatccctccttgctttgctccccttcctccatccctggcatcatccttctctgtcttagccacactctggccctggaacccgcctcctctctggcttccctgatgcaacctgtgcctcccataggtgacacaggggagatcaagtcagaagtccgtgagcagatcaatgccaaggtggctgagtggcgcgaggagggcaaggcggagatcatccctggagtgaggacccaggacatggccggggcgggtggtggggtggaggtgggccggggaagtggggacgcgggtggtgactctcacacacaccccaatccaaggtgctgttcatcgacgaggtccacatgctggacatcgagagcttctccttcctcaaccgggccctggagagtgacatggcgcctgtcctgatcatggccaccaaccgtggcatcacgcggtgagccggctacaggggcctctggggaaaacaggatgctctgggcagtgggtgtggtcagagggtcaatgggagcctgtgttgacaccgggtcagggagggacgcgtgactgcagtgtgcgctctttgcttacaaaaggcgggtgggaggcagctctgcttcccgaggaagcccagagactgtgttcttgctgcctttctgtcttgctgctcctttagcccccaaggctgcagttttcaaactgcatgccgaggcaccccagggtgctgcaggaaactcacaggagtgctgtgggatgttttctagtcttgagggaagcacagtgacatctgttagacataacataaactacgattgttcagtcacttcgacccagcaactccattaatagaactcttagcgttgtgtttggcctaaggatgccagggacagattcccatgacacagagggtaccgtgctctgctgaagcctgggaacctcgtctcccaggtgttgccagcaccctgtgtagctgggattacgggcacctgccaccatgcccgctggctgtcttctccacctcgccacattttggcccgcaggaagcaggggggtgtggagggcaggcagcccccataggctgtgatccacaggctgcaccccaaccttgcacccccattccattgcccggcactgcttgggctcagtgctgtacctggtggcaaagaaggctgggtactgtcagctccagccctgcagccttgggcccagctgaaactgggcggttgggatgggcatcacaaaagggaagaagcgggcaccctacagaggatgctgggccgctgggcctggctctgtgtttggctcttttaactccttggatccgcagaagaagctcagaaggtagatatcacctcagccccattttatagggcaggacagtgaggcccagtgacttgcccaggtcacaagtctagaaggtagcagggccgtaatttggtctctggatggctggacactggaagagacccccagggctgatggtgttttcacagaaactgcaggtcagggcctggggactgcccaggggcacctcctgtgggaggcagcagctacgggcagccctgattgttcgtagactctgtatctgagaatctcgcttgctaagatttatttgtaatccccaaataaatatctgccctgctttcggcaacaaattcaagtcacctgacacccactttcccagctgagtgtgaatgaggcaacactgcctgctcccttagcgctcatgctgtaaataagtgttcttgttgtattctatttagtgctacgtttgtcacttttgttctttgagacagggtcttgctctgtcgcccaggctggagtgcagaggcacgatcatggcacactgcagcctcagtgcccaccacacacactgcactccagcctgggtgacagaacgagactccatctcaaaaaaaaaaaaaaaaaaaaa

SEQ ID NO: 3491 - DNA, 2374 bp, Homo sapiens
ccacgcgtccggggaagcctgcaacaagttaagctgaagaccgaagcaagagctggttcagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaaaaaaaaaaaaaaaaaaaaaaaaaaaaaaaaaaaaaaa

SEQ ID NO: 3492 - DNA, 1182 bp, Homo sapiens
  misc_feature (496)..(496): n equals a,t,g, or c
  misc_feature (1162)..(1162): n equals a,t,g, or c
ctaagctggttcgcctgcaggtaccggtccggaattcccgggtcgacccacgcgtccgataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgccttttctccttatccttgncagcacttgtattgccagactacctaatttttgccagtctcatgggtagatagtggtscagtgctttamcatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggsccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaamaaaaaaaaaaaagggcggccgctctagaggatccaagcntacgtacgcgtgcatgcgac

SEQ ID NO: 3493 - DNA, 2074 bp, Homo sapiens
ccacgcgtccgcgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatytaagtggcccctccaccctctcccccagccgcacgggcactggaggtctcgctcccccagcctccgacccgaggcagaataaagcaaggctcccgaaaaaaaaaaaaaaaaaaaaaaaaaaaaaaaaaaaaaaaaaaaaaaaaaaaaaaaa

SEQ ID NO: 3494 - DNA, 3776 bp, Homo sapiens
ccacgcgtccgcggacgcgtgggtctgaagcttctgtcgaaccagttgtaaggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccactccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaaaaaaaaaaaaaaagg

SEQ ID NO: 3495 - DNA, 2109 bp, Homo sapiens
cacgcgtccgcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccaggacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagcaggccctgccgccatctgcccaagaccatctccttccattacctctctctgccttccaacctgaagacgcccatcacgctcttccgcatggccacagcctctgcccccggccgagctgggcccaacagcctgcggtttgggatcgtgggtgggaacagccgcggccactttgtgatgcagcgttcagaccggcagactggggatctgatccttgtgcagaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgccctctcaccagtgcacccaggcttctagggcagcattgcacggcgccccatggaatagcacggaagagcagccacaaaactcaactgctgccatcactctttttttttttctgctttgaggcccttcccttagattatgcactaactttcttaaaactttttcatccaggggatgggtggctttccaaaatgctgtgcaaatggccttgtgagtttgaactagctggggagagaaaaggtggcaatgtgtgtcaggtgactatcagcccttctgcctttttgtagccaggcttgctatgaatgaaacggttctagtcgtgcggggggccctagtcatgcctctgcgcatgtggcataggaagtggagtctcctcccatgacccagcacgttgttcttatctgccttttcctctgtgacatgcctgcctgcctgccttctcatcagagagtcacaggagggccttaaaccccacgcagatccttctagaccaaggacccattgttaaaagcatggattctgcctgagttacttcccttttgagaaatcatatctcaaatacataacctggtaatataactgaaaaaataaaagtgattgctccttcaaaaaaaaaaaaaaaa

SEQ ID NO: 3496 - DNA, 671 bp, Homo sapiens
gaattcccgggtcgacccacgcgtccggacttatgctactgtcatggacagtgctaataataatactgccttttgctggagatgttagttctcacttatgcattttaagaccttttgctggaagtgttagttcttgcttatctaattttaaacgaatatgaaagacaatttaagtgattttgtacattttaatttactcatctacattttcttgtattttttggattaaagtgtacctgtatgctctttctttctgtggaacacttcatttgtagtgtccaatttttaaaaagaaaacattttgataacagtttcagagtaatgacaaaccaaacacacattctaattgtctacttgtacaatttgttgggtaggtactatagggggaagaattaaatatacatgaggaagagaaaaaatctttgccaagaatttcagttattatcacttatggtttacccatattgtcataaaagtaagaaaatgggaattctaattttctgtcacaaaataaagattatataaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3497 - DNA, 2447 bp, Homo sapiens
aattcccgggtcgacccacgcgtccggggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggtaagtgaccacagcaggatggcagtgggtgggcagggtggcagagtagggtggagagctggctgggcagctggacacttagccccctgcagagcagagctaagtcaagctcaaaggatttaatgtacctgcctgtgaagcagaagggaggaaactgtctggcctttcctaaccagggatgaacaagaaactgaactaaactgccagaaaagacaatgagttttggaggtttttctccctgcagagataaaatgtgagatggaaataaatgtttttatcagtacagttatttggagctttgagatactgacttttcctctcaaacaaaccctaagattctcttctcctgcagagacttaatgctttatgtgtgtagatcaggcacagtttgctacattctccaatcattggttctaggaataacctgatgcccaattcttcatttttctttcatttaaaaacaatattacctaaagatgggccaggcagtaatgaaaatacgctggagagggatatgttaatatcctggccttcctctcaaattctcgtcatctaaagaaaaaaattcttggactctaccactgaatcggccagtaaactgttctgatgcaagggtggcctggagtagaatacagtggaggcattaaaggctaatcatgagaaaggcaagagtgcctagcaagtggctttgctaatctgatcactcttagtacagctggagtctctagaagtaacatccacccattcagaagccagggttacatatctaaacactcaatgagaccaaaagatagattgataaggtttcaagttcttgtcctcaatccctaacgtctgttgtgtgcaaatcaagtgccagttcctcacccttccccttccaatgcatttgtcaagtttcctacatacagaaagagtaatgattaaattaaaaattccatgtggctcttatatcctgaaccatacgcatgtaagccaagggatttaatagctgcaatcaattaaagtgcatcttgttggaatgctaactttctgcccagaaatcaagggaggaaattacattgctgtgcaaagaagaagaaaaaaccttctttacatacattaaaacctttccttaatccttcaagagaaagtaccgtggctagttccacgactgcaattggctttgcttctgttatgtgcagctatctcttagacttccaaaacataaaaaaaaaaaaaa

SEQ ID NO: 3498 - DNA, 1515 bp, Homo sapiens
acgcgtccgcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtaagtagcacccagagtccttgtggggagaccagggctttgctaaaggcatggctagtatggccagggccatagatcaagggccagagaaagagttgaagggaattttataatatgggcaaggatctcctctatgcctcacttctttcccagaacaactgtgctgatcccaggggttgtgattcaagggtattatggtcaggccagaggcccagggagacctgtgagagtgaaatgcaattatgaaagtgagatgatgtggaagaaggaactcagcctggcaccaggacctggcacggggtgactggggagacctgataccaagctgtggtttcagtagctttctcctctactgaggcctgctccagagactgtgggactctaatgctgagctgtttggggggggggtgggcatttcttaacagcaaccctggtggttaggaatatcctcacacctggtttcctccagtgaaggcccacaaggccggaattgattccaacctttatctgaagttgtttatagcctcaatcttgcacaatgagatctcacttagatctttgagtggcagccccctccctctaacgcccccatggctgcattcccatgatcctcaagttaaagacagtgtgtcttccccacttagcctttgtcttttccaggtcaagtgttataccctatttggccttttctcaaatggcagccctcatccccagatttcgtgagtctttagggctgtgaacctgaggttcttgagacttgagccaagtatgatagccctagaacaaggggccacttgaagctatcaggaattcctcagcagagaagggcactggggccaggcacagtggctcatgcctataatcccagcactatggaaggctgaggtgggtggatctcttgaggccaggagttcaagaccagcctggccaacatggtgaaagcctgtctctactaaaaaaaaaaaaaaa

SEQ ID NO: 3499 - DNA, 2190 bp, Homo sapiens
cccacgcgtccgcccacgcgtccgggcgcgtggaggggccccccgcatgggaagcagccccatggccctcactgccctgtgggccctgcatccccatcatgctggtcctggccaccctggctgcgctcttcatcctcaccaccgctgtgttggctgaacgcctgttccgccgtgctctccgcccagaccccagccaccgtgcacccaccctggtgtggcgcccaggaggagagctgtggattgagcccatgggcaccgcccgagagcgctctgaggactggtatggctctgcggtccccctgctgacagatcgggcccctgagcctcccacccaggtgggcactttggaggcccgagcaacagccccacctgccccctcagccccaaattctgctcccagcaacttgggcccccagaccgtactggaggtcccagcccggagcaccttctgggggccccagccctgggaggggaggccccccgccacaggcctggtgagctgggctgaacccgagcagaggccagaggccagcgtccagtttgggagcccccaggccaggaggcagcggccagggagcccggatcctgagtggggcctccagccacgggtcaccttggagcagatctcagctttctggaagcgtgaaggccggaccagtgtggggttctgaatccccagggttccccagagatccccgaggcaggccttgcctcagtgggaccggggaccccaggatccagcattaggattgagactgccccagcgaagatgcccttcccaggctccttccacctggagtccccctccccgggtctgggtggtggccaggctatgtggactaggggaagcccagcagtgcctctgctcagctacctgggctgtggctcagagacctgggggtggagccaatgccaggccagaagccttcaagatcgcatccagatgaagaacccaaggtactagatagtcaggaaatggcatcgaccagccacctccaccttctttcagtgtttaccgaagccaccaataccaaagagaacgggtcctgcggtgctgaacagcctcggtgtggcgatgacagctggcaggagatgacaggaatccagtttcccagagccacaaatcctgttctccttggccactcacccactgtgaggtcctctaggaaaatacacaaagagaggaccagaccaggcagaggaacattttgtttcatatgaactgtggctttgacccccaaactgcaaggaggaacttgctgggccaagctgcagcggcgctgtcttgctggagtggggacctagagtcagagaaaacccacaggctcctctgcccattctcctccatctgcacacgtctcagcctcggaccctcaccactccatggtgaggaaggccatggccaggggaaactgagtttcatccaatgtggagaggagcgttgtcctagagcagggcaactcccaaactgtgacctctgatcatcgtcccttccagcttgctggagtgtccagagagacagatttgccacaagctaggcttacttataatgctccaccctacagaaatgggaccccaagtacccaatcttccctttaggagaggcaggcaggtgggtgagcagcagatgtagtttccatttccctgggggtttaattttccaaactttgtctttttttttttttttttttttttttttttgagacagaatctcaactctgtcacccagactggagtgcagtggcacaatctcaactcactacagcctcgaactcctaggctcaagcgatcctcccacctcaacctctagaatagctgggactgcaggtgcataccaccacgcccagctaatttttgtattttttttgtagagacacggtctcaccatactgcctgggcaggtttccaactcctgggctcaagtgatccagcagccttagcctcccaaaatgctgggattacaggtatgagcactgcacccggccacttttttttgtttttgaaacagggtctcactctgttgcccaggctggactacagtggcacaatctcagctcactgcggccttgaactcctgggcttaagtgatcctcccacctcagtctccctagtaggtggaactacaggcatgtaccaccacacctgggcaacatagcaagagcccatctctaccagaaaaaaaaaaaaaaa

SEQ ID NO: 3500 - DNA, 2490 bp, Homo sapiens
  misc_feature (1)..(1): n equals a,t,g, or c
  misc_feature (1638)..(1638): n equals a,t,g, or c
  misc_feature (1687)..(1687): n equals a,t,g, or c
  misc_feature (1690)..(1690): n equals a,t,g, or c
ngaccaccgaggctgcctgtccaggggaaggggcccagccctcgacccccacaggcagtggctccaggctgttggggaggatctgccactggaatggttaacccaggcatttccagcagccaatcacagagctctgcaggaatacctgggagaggtcctcatgcagcccgggcgggtcctagcccagccccagtctggccctggacaaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcgccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcacccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggngtgtccctgcagctggcacccagcgagctccggcagcccaagccccccnacnagggctcccgcgcagacctggtggcggaggagagcccggagctgctgaaccctgagcccaggagactgagcccaggtgagccccaggtggcgaccccggaagggctgggggatctggggtttgtgtggagcgcgggttggggcgaaggcttggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgg

SEQ ID NO: 3501 - DNA, 2185 bp, Homo sapiens
ccacgcgtccggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccacctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaaaaaaa

SEQ ID NO: 3502 - DNA, 2144 bp, Homo sapiens; identical to SEQ ID NO: 893

SEQ ID NO: 3503 - DNA, 1291 bp, Homo sapiens
  misc_feature (1279)..(1279): n equals a,t,g, or c
  misc_feature (1286)..(1286): n equals a,t,g, or c
  misc_feature (1290)..(1290): n equals a,t,g, or c
aaacctcttctataggtaaagctggwacgcctgcaggtaccggtccggaattcccgggtcgcccacgcgtccggaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctacggcatcacatctccgggaatctttgctagcagtcaaccgggtcaaggaaatatacaaatgataaatccaagtgtgggaacagcagtaatgaactttaaagaagaagcaaaggcactaggggtgatccagatcatggttggattgatgcacattggttttggaattgttttgtgtttaatatccttctcttttagagaagtattaggttttgcctctactgctgttattggtggatacccattctggggtggcctttcttttattatctctggctctctctctgtgtcagcatccaaggagctttcccgttgtctggtgaaaggcagcctgggaatgaacattgktagttctatcttggccttcattggagtgattctgctgctggtggatatgtgcatcaatggggtagctggccaagactactgggccgtgctttctggaaaaggcatttcagccacgctgatgatcttctccctcttggagttcttcgtagcttgtgccacagcccattttgccaaccaagcaaacaccacaaccaatatgtctgtcctggttattccaaatatgtatgaaagcaaccctgtgacaccagcgtcttcttcagctcctcccagatgcaacaactactcagctaatgcccctaaaagaaaaaggggtatcagtctaatctcatggagaaaaactacttgcaaaaacttcttaagaagatgtcttttattgtctacaatgatttctagtctttaaaaactgtgtttgagatttgtttttaggttggtcgctaatgatggctgtatctcccttcactgtctcttcctacattaccactactacatgctggcaaaggtgaaggatcagaggactgaaaaatgattctgcaactctcttaaagttagaaatgtttctgttcatattactttttccttaataaaatgtcattagaaacaaaaaaaaaaaaaaaaaaaaaaaaaaaaaaaaagggcggccgctctagaggatccaagcttacgtangcgtgcntgcna

SEQ ID NO: 3504 - DNA, 1403 bp, Homo sapiens
ccacgcgtccgcccacgcgtccgtgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctggttctgttgtgaaaaaaaaaaaaaaaaaaaaaaaaaaaaaaaaaaaaaaaaaaaaaaaaaaaaaaaaaaaaaaaaaaaaaa

SEQ ID NO: 3505 - DNA, 1594 bp, Homo sapiens
ccacgcgtccgaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctatgataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgaaagcaagaaaaaaaaaaaaaaaaaaaaa

SEQ ID NO: 3506 - DNA, 945 bp, Homo sapiens
  misc_feature (927)..(927): n equals a,t,g, or c
  misc_feature (929)..(929): n equals a,t,g, or c
tgtggaattgtgagcggataacaatttcacacaggaaacagctatgaccatgattacgccaagststamtacgggaacctctactataggkaaagctggtacgcctgcaggtaccggtccggaattcccgggtcgacccacgcgtccgaaaaaatattcttatccaagctcattgtctgttttctcagtacctggttaccatttgtactacttcaggtaatcattgttttmcttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctatgataccagttattaaatagtgttttattttaaaamcaaaataattccaagaagtttttatagttattcagggacactatattacaaatattactttgttattaacacaaaaagtgataagagttaacatttggctatactgatgtttgtgttactcaaaaaaaactactggatgcaaactgttatgtaaatctgagatttcactgacaactttaagatatcaacctaaacatttttattaaatgttcaaatgaaagcaaaaaaaaaaaaaaaaaaaaaaaagggcggccgctctagaggatccaagcttacgtacgcgtgcatgcnanaacataactcgaagtt

SEQ ID NO: 3507 - DNA, 2089 bp, Homo sapiens
ctctaatacgastcactatagggaaagctggtacgcctgcaggtaccggtccggaattcccgggtcgacccacgcgtccgagaactcacaggtacttttccagccacccagataggagagatcattaaaacagtgcattctgtgctacctgacacctattgggacattcgtcatgtcctcaaatacaatgcttcaaaaaacgctgctgatcttgatctctttttcagtagtaacctggatgatttttataatttctcagaacttcacaaagctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctactggaggtgagggaccacttgggacagaggaagcaatatggtggggatttcctgagggccaggatgtcctccccagcactgacggcaggtgcttcaggaaaggtgatggacttcaacaatggcacctacctggtcagcttcactctgttctgggagggccaggtctccctgtctctgctgctcatccaccccagtgaaggggcgtcggctctctggagggcaaggaaccaaggctatgataaaattattttcaaaggcaaatttgttaatggcacctctcatgtcttcactgaatgtggcctgaccctaaactcaaatgctgaactctgtgaatatctggatgacagagaccaagaagccttctattgtatgaagcctcaacacatgccctgtgaggctctgacctacatgaccacccggaatagagaggtatcttatcttacagacaaggaaaacagccttttccacaggtccaaagtgggagttgaaatgatgaaggatcgtaaacacattgatgtcactaattgtaacaagagagaaaaaatagaagagacatgccaagttggaatgaagcctcctgtccctggtggttatactttacaaggaaaatggataacaacattttgcaaccaggttcagttagacacaattaagataaatggctgtttgaaaggcaaactcatttacctcctgggagactctacactacgtcagtggatctactacttccccaaagttgtaaaaacactgaagttttttgatcttcatgaaactggaatctttaagaaacatttgcttctggatgcagaaagacacactcagattcaatggaaaaaacatagctatcccttcgtcactttccagctctactctctgatagatcatgattatatccctcgggaaattgaccggctatcaggtgacaaaaacacagccatcgtcatcacctttggccagcactttagaccatttcccattgacatttttattcgcagggccatcggtgttcaaaaggctattgaaagactgttcctaagaagcccagccactaaagtgattattaagacagaaaacatcagggagatgcacatagagacagagaggtttggagacttccatggttatattcactatcttatcatgaaggatattttcaaagacctcaacgtgggcatcattgatgcctgggacatgaccattgcatatggcactgacactatccacccacctgatcatgtgattggaaatcagattaacatgttcttaaactacatttgctaagggataaatactatacaaaatcactaggaaccaatctctgcacataatcccacatgtattgtaaagtaagttttactcattttaggaactaaggaaaataaatttaaaagaatctgtttggggaggaaggctatgtaaggacaatgacaactgataagggatgcaaaaccaagagaatcattcatgaagaatgactataccatgcctggttctgatgctcgtttaaaatattaaaaaagttttttaaaaaaaaaaaaaaaaaagggcggccgc

SEQ ID NO: 3508 - DNA, 1593 bp, Homo sapiens
ggggacctggccagccgtgcagctgcccaggcgctatggcgagtgcggtcagggggtcgaggccgtggccccggctggggctccagctccagttcgcggcgctgctgctcgggacgctgagtccacaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatgaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatacatgagccacctggcgtcctgcgggatgggcctgctgctcactgtggacccaggaagcgggacggtgctgtggacacaggacctgggcgtgcctgtgatgggcgtctacacctggcaccaggacggcctgcgccagctgccgcatctcacgctggctcgagacactctgcatttcctcgccctccgctggggccacatccgactgcctgcctcaggcccccgggacacagccaccctcttctctaccttggacacccagctgctaatgacgctgtatgtggggaaggatgaaactggcttctatgtctctaaagcactggtccacacaggagtggccctggtgcctcgtggactgaccctggcccccgcaratggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcasagacaagacctccakagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagcctggggctgatgaagcagagatgttcgctggatcccaggccctggcacccctcaggaaatacaagaaaaagaatattcacatctgtttaatgtgcataaagccaaggaaaggccaaaaaaaaaaaaaaaaaaaaaaaaaaaaaaaa

SEQ ID NO: 3509 - DNA, 1215 bp, Homo sapiens
  misc_feature (907)..(907): n equals a,t,g, or c
gcatttacaagcacttcagcgccactttggcatatgtgaaactctccaaggtactgaacttctatgtggctaatgcagatgactccagcaagactgaactgctttttgctgcgttgaaagccttgaagtacttgtttagattcatcatccaatcccgagtgctctacttgaggtaatgttaactgcagtgaagatgtttagattatcagctgtcactctgtgtgctttttccctcactctgcacagtggtgttcagctctgtgagcagttagttcttagaattgccttatttcagaactgcagggctgaagatggatttgggctgcgtgtctgttggagaagactcatgagaagtttttgtagatcagcaaaattctggggcagtaatgacctcaggacttggggaagcagattcctgtggaaagattgtacctaatacagcagatgacttcatgacaatattgagtgtgcaaatctaggatcatgatctgctgtcgctagcagaagcagcagtcatctcaggggaggtgttgcctgagatgagtgtttccttgttgacactgtgcttagctacctgggcaactaagcactagagacaggaytattccctgtttggatttctagcataacagttccatcaaamacagaagaaactgcaaaagagcaagtacctttgcagggaacattcacaaccccagtgactttcctacccttcagaaatagctgtatttccaaactgttaaaatttttttctaaggaagaaagaaaaggtttgtagaattgagcatatgtatttttaaaagaaactttattgaaaaaaataaaattaaaggcaaacaacctgcaaaaaggttacatatagtacagatgaaagtttaatagcttttctcagttaaagcttttatanatcaataaagaaatgataaatagccctaatggaaaacaaaaacaggtaatttacaaaagaaaaacttaaatggtcaataaactttttaaaaaatttcatactatcaaaagaattttgatacagacgcacacacatgcatgcacacacacaccatcttttacctatacatttgaaaaagattagacatctttgtccttgatgagattgggcaaaaattggtcctgtatttcagttttgatgctaatggagatataaattcttcaggatagaaatagatagtctgaataaaaccaaaaaaaaaaaaaaag

SEQ ID NO: 3510 - DNA, 727 bp, Homo sapiens
  misc_feature (1)..(1): n equals a,t,g, or c
ncgagacccacagaacgaccgacggaccgagggttcgagggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccggaagccatcactgctatcatcgtggtcttctccctcttggctgccttgctcctggctgtggggctggcactgttggtgcggaagcttcgggagaagcggcagacggagggcacctaccggcccagtagcgaggagcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttata

SEQ ID NO: 3511 - DNA, 1629 bp, Homo sapiens
accagtataggtgcaaagctggtacgcctgcaggtaccggtccggaattcccgggtcgacccacgcgtccgggttgtgtcacggaacggcagggccgcctttaggcttacatccctggaactcccacctccacagacccgtccgggtgctgaaagtccacggatgctatccctggtcaaatcagaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaayttsgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggccaaaaaaaaaaaaaaaaaaaaaaaaaaaaaagggcggccgc

SEQ ID NO: 3512 - DNA, 464 bp, Homo sapiens
  misc_feature (21)..(21): n equals a,t,g, or c
caaacccttcagtggatgagnccaagtcgcagaaagcattctgttgacagatgaacagccgaaagctggccagaccctcctgkatgcactcccwgccccktktatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggaaaaaaataaaaaaaaaaaaaaaaaaaaaaaaatcggggggggggcccgg

SEQ ID NO: 3513 - DNA, 687 bp, Homo sapiens
  misc_feature (461)..(461): n equals a,t,g, or c
  misc_feature (481)..(481): n equals a,t,g, or c
  misc_feature (534)..(534): n equals a,t,g, or c
ggctgtgaacactgcatcttagatgtgggattgttcttcactgtagtgagagctaagaaaagaggcagcacttggcacccttaatcacccaaattaagcaattattctgatcccccattcgaaatgaattggtatcatgagaacaaagaggcaacatgcaattgccaaatatttggcctatattttattgtttcctttctttctccagtactggcagcagcccatgatgctaagaaatatcccgtttggttatgaagttaatgtggagattaaaagtcattccctgttctacccacaccctttttcttgtgtatagcatgtgactgagctgattggaaggcatatagcccagtggccaagcacttgggcctcagtgtgatggctgacacatgtttctgactctgtccatttctatwttgttgtggacaagccttggctttctcagctgtcaaatgggggtnacaacagctctacatatagncctgtagcaattaaatgaaagcatttagggccaggcatggtggcttatggcgntggtcccagcacttagggaggccaaggcaggacaaagtgggctcttgtctttgagccctagagtttgagaccagcctgggcaacatagtgaggccctgtctctaaaaaaaaaaaaaaaaaaaaaactcgagggggggcccgtacccaatcgcc

SEQ ID NO: 3514 - DNA, 1114 bp, Homo sapiens
tgtgtatttggggggactgaagggtacgtggggcgaaacaaaaccggccatggcagcagcggaggaggaggacgggggccccgaagccaaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatataaaaaaaaaaaaaaaaaaacycggggggggccccggtccccattccctttggggggt

SEQ ID NO: 3515 - DNA, 987 bp, Homo sapiens
  misc_feature (982)..(982): n equals a,t,g, or c
  misc_feature (984)..(984): n equals a,t,g, or c
ggcacgagcgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataawaaaaaaaaaaaaaaaaaaaaaaaaaaaaaaaaaaaaaaaaaananaaa

SEQ ID NO: 3516 - DNA, 983 bp, Homo sapiens
  misc_feature (976)..(976): n equals a,t,g, or c
cgacacggctgcgagaagacgacagaagggcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaacttttgggccgggcccctccccacaataaagatgctctccgaccttcaaaaaaaaaaaaaaaaaaaaagrkgsggccggtccccantcccccc

SEQ ID NO: 3517 - DNA, 757 bp, Homo sapiens
  misc_feature (756)..(757): n equals a,t,g, or c
gacagtacggtcggattcccgggtcgacccacgcgtccgcggacggtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttaaaaaaaaaaaaaaaaaaaaaaaaaaaaggggggccccnn

SEQ ID NO: 3518 - DNA, 570 bp, Homo sapiens
  misc_feature (6)..(6): n equals a,t,g, or c
gaattncgcacgagctcgtgccgtttcattctgtttagaagttcatgttcatcttagccatttggaacttcttcattctctatcttttctccacggtggctgggcttgtctgcaaatcattgtgtcaaaatcaaactattttcaaaacagccctttgcttctgagcccctcccctaagtcctctgtgggggtccatgattctgcagaggtatgggacagaatcttcagattttaccccttgagtctcttcctagtcatatcctggttccctcattctaatattgacaaaggatgactcattaagtgcaactggttatgtaactttcaaatactttcattgtgtatgtcaggatctgaggaacaaaatgatgtcatttaatcggaatctaaatgtgacacaaacaacgtgccagcaatacctgcttgtgaaataatgttctgagcccacagtgttcctgggtatgtgagtttatatcaagtgaaaaggctgcttaattgacattaaagttttggaatgtaaagcttcaaaaaaaaaaaaaaaaaaaaaaaaaaaaaaaaaaaaactcgtag

SEQ ID NO: 3519 - DNA, 998 bp, Homo sapiens
ggcacgaggcttaagtcaagccacctgatcagtcttgtaaccactggagagatgagcagtgtttagtcatgtccctaatactgttattgtcagtcacccttttacatctgtctttttctgttggcttctttctttttaggttgtaggggagacccattgtctagagagaatatacgctttgacttgatgaaatcccagtttaatctagaaaggtccattttgaggttaagaacatttcggagatgtggaggtgaagatataaagtaggtctcagctttggctggccaatatgggatcctacttatctcctcaggggactggacaattcgtgtcaagactctgtgcttcaggagcctctgcttcttcctccttcatggtccaactttcctgccccttcttcatctcattagcttaaccctcagttgcctgacccaagtcaaggtgtgtgacctggtcctgatcaccacctctttttgggggcttctgcaactgtgctctgtcctggcaacctgcttctgtaatctgtttatccccaaatttgaatgagtaataggaattgcctaaattttggataaattatcctacaaaataaaagcattctcacattgccctctcaaatcacatgatctttgtagaaaatggccggtccctatgaagctaattgatctttggcatcaatagggaaattcagctgggcgcagtggctcacacctgtaatcccagcactttgggaggccgaggtgggagggtcatttgaggtcaagcattcaagaccagcctggccaacgtggtgaaaccccgcctctactaaaaatacaaaaaaattagctgggcgtggtggtgtgtgcctgtaatcccagctactcaggaggctgaggcaggagaattgcttgaaccagggagatggagcttgcagtgagccgggattgcgccactgcactacagccaggatgacagagtgaggctccatctcaaaaaaaaaaaaaaaaaaaaaaaaa

SEQ ID NO: 3520 - DNA, 755 bp, Homo sapiens
  misc_feature (748)..(748): n equals a,t,g, or c
gaattcggcacgagattgtgcacatgtaccctaaaacttaagatgtaataataataaaataaaataaaataaattaaaaaataaaaataaaaacaratttaatgatagggtacttaatgaaagtwttggtggtccttgaatgacgtattttacactacatatgtacctacttttctattctcctcctcagatgggaaaggtctagataaactggcctctatcccgcagctcttctccacaatggttaagaacagttcaacacggaggaccagcagtaaatgacctttaaaaagtgtaataataactattgcccaaaataatcttattaatcatagaaaatggcttctattcttctgctccttgttctgtcacacagctgttgctgtaaaaacacttgtttacaggttctatgtaattttgactcagtccataatctctccaccctaattttaaaaattatcatcagggtggatgtgctagtatactaagaaacatctgttaatattatttattttctttatttaatctttttcatagattcacttgttttaaaatatcttaggtttataatctctttgcaaagctcaataaatcattttaacagctaaaaataaaaacttaaaaatgaactccagataaatatgaagattcaaaactatgtggaatctctgcccccctcttaatactcaccaataaattctacttcctgtcmaaaaaaaaaaaaaaaaaaaaaaaaaaaaaaaaaaanaaaaaaa

SEQ ID NO: 3521 - DNA, 2045 bp, Homo sapiens
  misc_feature (2)..(2): n equals a,t,g, or c
  misc_feature (5)..(5): n equals a,t,g, or c
gnttncggctcgggtaccatcctccgcgccatggacaccagcgacctgttcgcagctgcaggaagggggatgtgggccgagtgcgaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggcctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttggtgcgagcagggtttggggcccggggccatgggtgcggcctggcagggctggcctggctccctgaagttgttcttcccctgtagtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcmccgtgggaaaaaaaaaaaaaaaaaaaaaaaaaaaaaaaaaaaaaaaaa

SEQ ID NO: 3522 - DNA, 777 bp, Homo sapiens
  misc_feature (761)..(761): n equals a,t,g, or c
gtagcaccttgaaattgggcagttctgaatatgctgttgagtaaagggaaaatcactatctttttaggacctttggaatgtggctccatgcatttgctaacgttgttctcttcagggctgatttttctgggctgttctactcctctatccttctgtgattgtcttccaattcttttattatggttagagttccctgtagaaaccagtggggtgtgtagttaacaagtgtcaaaaggagtagaataattactttatgtgatgtacttacgagaatactacttagtagaatccagtataaccaaacaaaatgtagacgtatttaactatccagtgtgtcagctacacattttctcatctttatcacttctgctctggatattgtgatctactttcctatctctttgtatttgtkttttcacatttcttttttgtgtaaactgctctatactcttattgaaacttgagcataattttatatttacatagtaaagtttctgatatgattagaacataagttgtwtctcctaattttccaatagagccattgatktttcattttaaccccttttaatggaacacttactagctttctaaattataaacttactaactttaaatatacatgaattatttctcagcattcttaaaacaagggtactgaacttcgwtttcttgatgattcaggggaaaagaattctgagtgttggaaaggactttagatgtcttccaaggatttatgggatcaatttaagaaaaaaaanaaaaaagggcggccgc

SEQ ID NO: 3523 - DNA, 2425 bp, Homo sapiens
  misc_feature (854)..(854): n equals a,t,g, or c
  misc_feature (858)..(858): n equals a,t,g, or c
  misc_feature (1155)..(1155): n equals a,t,g, or c
  misc_feature (1253)..(1253): n equals a,t,g, or c
  misc_feature (2197)..(2197): n equals a,t,g, or c
tcgacccacgcgtccggctaaatatagacgggagtgcttgtggtttgatcatcaaaggagccatgatgggtgagaggtgtctagctctgaatgtcctgtttgctggggttgcttcttgccagaggcttttcagcaggaatcttagctgtcactgctttggggactattgtgatccttctctctagagctctttcaacgtcctgtgctgactgccagctccttccagcccatcgaagggggtccagtgagcctgaaatgtgagacccggctctctccacagaggttggatgttcaactccagttctgcttcttcagagaaaaccaggtcctggggtcaggctggagcagctctccggagctccagatttctgccgtgtggagtgaagacacagggtcttactggtgcaaggcagaaacggtgactcacaggatcagaaaacagagcctccaatcccagattcacgtgcagagaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccagctgtgaaagagagtgatgccggcaaatattactgtagagctgacaacggccatgtgcctatccagagcaaggtggtgaatatccctgtgagaattccagtggctcgccctgtcctcaccctcaggtcttctggggcccaggctgcagtgggggacctgctggagcttcactgtgagggccttgagaggntctnccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcangagaaagttctgccactaatgaacccagaggggcttccaggccaaatcctcaagagttcacctattcaagcccaaccccagacatggaggagctgcanccagtgtatgtcaatgtgggctctgtacatgtggatgtggtttattctcaggtctggagcatgcacgcacgccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcacctgcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacatnacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatctaaaaaaaaaaaaaaaaaaaa

SEQ ID NO: 3524 - DNA, 1060 bp, Homo sapiens
gatgtatttccttaatatgtagtttcagaagtggaatttattagagttaaactaaactcattaaatttagagtttcttattgtctttcatgagaacatttttccttttcattcataaatgatattgaaacactatattcttactttcatattcctgtttatatttttgtttttcatgttaaacattttacattctaatagtaacctcatcgacctgttaaaaggcaatataagatttagattattaaatagcatgtaatatatgtgatcagtaatcttcaatgagcttgktcttcatttaattgcaacgttatgtctgattttttttgktgcaaagctttcagaatcttgacttgtggtaatcttcttttaaaaaagcttttaacagaattaatargtcatcacgttatgataaatgattaaggaaatgatgcctctaatacatkgaattattaaaactatcattttgaaaaattatattggtacaaactagtgtctactgctattactcatacatttcagaattcatacatggatatcgtctaggattttttttttgcgtaatcatgagttacggtgttaaagttatagtgttaatttaattatgttatagtgttaatttatctgttttacatctcacttttgtatctgaaaccgttcgaaaataattattattaaaggccagttgacaaaatttccactcctcctccccagtgtgactttccttatttgtattatacctataaagactacctcttacatcggccaggcacagtggctcacgtctgtcatcccagcactttgggaggacgaggtgggcagattgcctgagctcaggagttggagaccagcctgggtaatatagtgagatcctgtctctacaaaatatacaaaattagctaggcgtgcctgtagtcccagctacttgggaggctgaggtggtaggatggcatagagtccaggaggcagaggttgcagtgagctgagatggtgccactgcactccagcctcagtgtcagagccagtccctgtctcaaaaaaaaaaaaaaaagggcggccgc

SEQ ID NO: 3525 - DNA, 626 bp, Homo sapiens
ccacgcgtccggaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaatttatatatatataatataaaatcacttggtgattaaaaaaataactgctccataaataaaactcctaaagtcacttatgtttaaaaaaaaaaaaaaaaaaaaaaagg

SEQ ID NO: 3526 - DNA, 1201 bp, Homo sapiens
  misc_feature (29)..(29): n equals a,t,g, or c
  misc_feature (48)..(48): n equals a,t,g, or c
  misc_feature (63)..(63): n equals a,t,g, or c
  misc_feature (1201)..(1201): n equals a,t,g, or c
taggcttttgcaaaaagctttttaggtgncctatagaaggtacgcctncaggtaccggtccgnaattcccggtcgaccccacgcgtccgaaggaaactacttgagragggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtaaaaaaaaaaaaaaaaaaaaaaaaaaaaaaaaaaaaaaaaaaaaaaaaaaaaaaaaaaaaaaaaaan

SEQ ID NO: 3527 - DNA, 1208 bp, Homo sapiens
  misc_feature (9)..(9): n equals a,t,g, or c
  misc_feature (59)..(59): n equals a,t,g, or c
  misc_feature (79)..(79): n equals a,t,g, or c
  misc_feature (814)..(814): n equals a,t,g, or c
tagcgcggncgatccattccccagaacactataccctagctttcaaaactattagtgcntataaaggtcgcctcaggtncggtcgaattcccggtcgacccacgcgtccgctagaaagagaggtagtgctctgcagggccacgggaggactcagtgacgacttgaaagcatcaaacacagtggagggctcatacggggtgctcagtagatgggcgcatcattttatagaatactgaggcccagagagggaaggtgtcttgtctgtggtcgcatgggggctcagtgggaaagccgggactaaaagctggccccaggctagctttgtgccaggccatcctgctcttacacaggggctgagaaccaggggcagcccaggagtcctggatggggcagcagtcatgttggatggggctggggtgttggctctccctttctgggctctcaggagtggtcagggctagccccagatctcccagaccaagaagaggagcagcctgtggggagacactcatgccctgacatgagtcagtgcatcaagagaggccatcagccagtgggattcagcaagcatgcctggcgctgcctggtagggtgctgcccatgggaggaagagaagaggagctgccacccatttggggccytccttctctgggtcctcagatttgcccttcagcccaragtctatgaagaccccgcggccctggatggtggggaggagggcatggacatcwttacccacattctggccttggcaccccggctcctgaaagactctggtagtatcttcttagaagtggacccaaggcacccggancttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaaaaaaaaaaaaaaaaaactcga

SEQ ID NO: 3528 - DNA, 1052 bp, Homo sapiens
ccacgcgtccgcaaccaggttcaagacgagtaagaggaatgcaagttatctttttccaaaaagaattgttttcaatttaattaagttttaaattcgaaaggagaataatggctcatgtaaaatgtgggcatttgcaaataagtaatatgattgtgtgtgtgtctgtgggcatgtgtgtatgacagagagagagggagagagagacagagagagagagtcagtggtcagtgtctgtggatttggggacaggatatattatgatacatggtcccctggttccttctttggagttccttcttcataggcacatcatcagcctatattgacaaacaggtaaagattgttagacaaaaatctacctattggggagaaaaatttttaaaaagatgtgaaagggaaagaataaaagagagtgaacaatcaggcaagagaggagaattaagagaaagacagcaaaagtcaaatgaagcaggctgcatctatcagtccattatactcatttaggggtgtaagtgtgcttctctgaatctgagagagtcagagtcttttaagaaaggaagaattcaagattttgcaatatctattaggtataagaatgtattttttaaaagttaagcaattccaggcaacaacacatatcagatgcatgttgtgggcagagccagggtagcaagcttagggaatcactgcaaagaaaattgtatgtggactttgggtttgtacttgaggcaggtagacaaatatgtatgaaactgtgtttgacatacctaacaaaaatccatcaatgggaatttctcctaccacagcattgcttcattgctgacataaatgggacagaaaggaaatctttttttaaaaaaaaattaataactagttaaggctaggatggaataatgtgtggtgctctgccttgttccctgatgacatttccatttttctaaggaagaaatctctattgatttagttttgcctgattataaaagtaatacaaatttctttctcaaaatgcatacaacaaataaaaattgatgaaaatcaaaaaaaaaaaaaaa

SEQ ID NO: 3529 - DNA, 431 bp, Homo sapiens
ccacgcgtccggggatgggaacccaaggctgtccacatcccagctggctgctccttctggggctgtcttggtggggagagggagatggggcagtgggtccctgctgacccctgagccctgcaggggtcaggatcctcccgtggtccctgggtgtggctctggaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaaaaaaaaaaaaaaaaaaaaaaaaaaaaaaaaaaaaaaaaaaaaaaaaaaaaaaaaa

SEQ ID NO: 3530 - DNA, 448 bp, Homo sapiens
ccacgcgtccgtgctggactgcttggtgaatccacaagtaaccaggatagtggcacaacttttgatacaaggaagaagtttatgattcaagtggaagatgacttttaaaataatattttttaaatatatatttttaagtagtatgactaaaataaagatgaaccagcaaaaggtcagtttgcacatttgtaaatgtatttatccttaccgaattacatgtcagtctgttgccaccttctttcatgcacattcctctttggccaaactggctgctctttgtttgtaagcttttgttcctctctcatcccatacttttagcctgtgtcaaatgtaagtcccaagtatttccagcaggaagtaatgtcttcctcagcctcaaccagggaccaaccggctgcttacttttgcaaataaaattttactagaacacgaaaaaaaaaaaaaaagg

SEQ ID NO: 3531 - DNA, 1405 bp, Homo sapiens
gctggcctgaattatagttcttaatcaaagtaaaacatgagaaggtaaatatgctaccataacaaaacttcacaaattamagccaaagagacaagaaatatgagacctggagagagtggtatatttatcttgtttggaacctttattttttagtggagacaccaagtctcagagagataatgtgacttatcaaaggacacaaagtgatttaatgagaaaatcaagattagagcctccaaagttctgatctactgtttctccatgttgcatctgatttattattttgttgttattattcaactaatgatagcaagagctgacattcctcagatagctactgtgtttccagggcagtgtgttaaaagtgtcctgttatgcattatcttatttaatcctcacagttaccttttgtgtgttctcattttatggatagagatgctgagagttagaaaggttaagccaccttttcagagtcmcatagctagttatctgcagaggaaattcagcactgatttataatmcagtccacatacttaagtgtgtgtgtgtgtgtgtgtgtgtgtgtgtatgtgtgcatacactgkctcccaatccagtgtaaacttcttcctgcattttaagaccaagaagcaagggcaagcttgcacgacctgaaagactgaagggttatgctgcctgtggcacattcttttttttgtaaaatctccagttgacttctgaatagttcttctctgttgatcttaccaggtacttctatgtcctacccctgcttagggcctggaacataggaggcactcattagatgacagctgaattaatgaatgggatgtttggatgaattgcaatttttaaatctcattctgttaaaaagagggggaatggkaaactcagacactagaggaacaggttctyaatccattccaactttgattaacattctatgktccactcacattccaagaaaaccaggtgactttgcttttttcggaatcatgaaattttggattgaaagtagatttctagaccatctttctgtgtattctaaaatgtaactttgaaagtacgcttctcttaatgactacaggcattaaaaccagatgcagctgggcgtggtggctcgcgcctgtaatcccagcactttgggaggccaaggagggcagatcacgaggtcaggagattgagaccatccggctaacacagtgaaacctcgtctctactagaaatacaaaaaattagccgggcgtggtggcgggcgcctgtagtcccagctacttgggaggctgaggcaggagaattgcttgagcccgggaggcggaggttgcagtgagctgagatcccatcactgcactccagcctgggcgacagagtgagacttcatctcaaaaaaaaaaaaaaaaaactcgag

SEQ ID NO: 3532 - DNA, 815 bp, Homo sapiens
  misc_feature (1)..(1): n equals a,t,g, or c
ngcttcaccgtgcactttcatgttagagagatcttaaacttcaagaaccaacctctgctagcttgagacattttttcctrcagcttcctcacctctctcagccttcatggaattgaagagagttagggccttgttctggattagggtttggcttaaatgaattttgtggctgctctgatcttctctccagaccaatacaactttatattaaggataaggctgttttggtttcttatcatttgtgtgttgagtggaatattacttttatttccttcgagaaccttttctttgcatccataacttgggctaactatggtgcaagasgcctagcttttggcctatctctgctttccacatgcctttctcactaagtataataatttctagcttttgagttaaagtgaaagacgtgcaacccatccttttacttgaacccttagaggccattgtatggttaatatatggcctaatttcaatattgtgtctcagataatagggacgcccgagtagagggagagagatgggaaaatagcagtcaatggtgtagtcagaacacatacagcatttactaagttcaccatcttatatgggtgcggttagtggtgctccaaaacaattacaatacaaacatcaaagattactgagcacagatcaccaagtagaaacaattataatgaaaaaatagggaatattgcaagaattaccaaaatgtgacacagagacatgctgtaaaaatgatcccaataaacttgcttaatgcacagttgccacaagctttcaatttgttaacaaaaaaaaaaaaaaaaaaactcgta

SEQ ID NO: 3533 - DNA, 2145 bp, Homo sapiens
  misc_feature (988)..(988): n equals a,t,g, or c
  misc_feature (1123)..(1123): n equals a,t,g, or c
  misc_feature (1167)..(1167): n equals a,t,g, or c
cccacgcgtccgagagttttatataaacttatacaatctaaactcttgctcttcctttctgactcctgagggtgagtgtgatggactagaagaggtagccttaaaataagtgagcagctagggaacatgctcaatgggcaagagaaaatgaccactgaccagtcaatacctgtgtcagggggagttaccagtacctatatttatttttaaagtaattaaaaagtagaacacttacaaattttccacctatacatgccatgtcttcctcggggacagtagccacatcttatatatttcccaccatgcataggacccagcacacagtgaagccagtaggcactcagtgttgaatgctcataccaggttttctgcttcctgtagttaccctgctgagcactgcttccatcacaggtgcactgggcctcaacacttctgccatttccccatttgtctcctccatggacactgtcaacaatggtctgtcaacacctgctctgtgccaaagccagggagtaggctggggggatacggaagagaatatctttctccttgatgcctgctgtgccaacagccccctttaagccttgttcacagcctttgctgaaacaagcatcttgaaagcaagccatgttatacaccgcatgaccttcatgctctgggcccagctgactgaactggggcaggccccagagtcatgggcagcctattgtcttgctaatggcctctgacttagcctggagtaaaacactgtccaaacaagactggtggttattcaagcataagaatttgaactaggaagccaagaatgaagcaaccggaccattaccatcaaaaaatgattaaaggatgaagaargaagccaacattcagagagtatctggttcatgttaataatggtatcatattaaaaggaagatacatgaacttctactccaaaagctcctaaaactgcctttgcccacaatgaacagtgtaccctaggcctggnttctgttcttggattcctagatagtctttcttctttgtcactgtgctgatcatttcagtaaaccccccactaaatcagtgcagctctgattattgcaactaaaacgatccaaatgaagtctccctttctagatgntgggttggagggatgctaagacaaagatgcttaggctccagagntttacagagcttcattcaataacactctactttccaaagaacttaaatatgaggtctgaaggacttggaccaagaggcaaacccaagctacagacaccatgttgyactcagagtgacctctcccctctgacagcccaggatttctctatcaagtccataagctagtcatatctaggaccatcttgttaaaaattctctcaaagtctcctcagccctcttgtaaacagacttctggaaggtccacttcatcagtttgttatatactttcagactgtctatctcttgtttagattcagcatggcaccgtacgttgaatggactgttaatagatgtttgctgaatgactccaccacagcattggacacatcaggggtacagccaaatgcagcatgatacctctatcaggaaaattaaattttaacacagccaccaaatattctatatttgaagagtatatgctaatcatgcaattttaagtaaaaaaaagctgaatacaaaaaaagctgaatatgtgttttatatcctygtgaattcaaagtaaaaaggaaaaaaaactcaaaaaccaaatatatgtatgcagtttgagcccaaatttttaattaagtaaccatataattacatgtagacatgtataaaccttgagatatgtaaagaccagaaaaatatttaaaagttaatagttacatcatctgtggtcacaacaccctgaaaatgcctaatattggaaayttaagcaggattgatccaggttattacttggatgggagaccagatgctataggctgaaaaaagaaagcataagtacgcacaagttaatacttaataattatctcctaatgataggactataagttctatctcttttctttacattgttcagtattttcaaatttccctttgaaaatgtgttatgtacttgaattattagaaaaaataaatgtcatttaaaaagcaaaaaaaaaaaaaaagggcggccgc

SEQ ID NO: 3534 - DNA, 2709 bp, Homo sapiens
ggcacgagatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccatgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacattcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaattctatttttaaaatgtgattttctataactgaagaaaaatatcttgctaattttacctaatgtttcatcctttaatctcaggacaacttactgcagggccaaaaaagggactgtcccagctagacctgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttaatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtcttttaaaaattaaaaattttacttgattccccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaacttttcattttattcatttaaaaactagaataacagatatataaaagtgttaatctttgtgctatatggtatgaaatacaatattgtactcagtgttttgaattattaaagtttctagaaagcaaaaaaaaaaaaaaaaaaa

SEQ ID NO: 3535 - DNA, 1547 bp, Homo sapiens
ggcacgagcggctgcgggcgcgaggtgaggggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcagcgccgcgcacttctacttgcacacgtccttctctaggccgcacacggggccgccgctgcccacgcccgggccggacaggacagggagctcacggccgactccgatgtcgacgagtttctggacaatttctcatgctggcgtgaagcagagtgaccttcccagaaaggagacggagcagccgcctgcgccgggggagcatggaggagagcgtgagaggctacgactggtccccgcgcgacgcccggcgcagcccagaccagggccggcagcaggcggagcggaggaacgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcgggtgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgattcctggggaagctggagactctggacgaggacgccgcgcagctgctgcagctactccaggtggaccggcagtccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaaaaaaaaaaaaaaaaa

SEQ ID NO: 3536 - DNA, 1380 bp, Homo sapiens
cagacccgcggggcaaacggactggggccaagagccgggagcgcgggcgcaaaggcaccagggcccgcccagggcgccgcgcacacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcacgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcacgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacacctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctcaaaaaaaaaaaaaaaaaaa

SEQ ID NO: 3537 - DNA, 610 bp, Homo sapiens
  misc_feature (25)..(25): n equals a,t,g, or c
  misc_feature (74)..(74): n equals a,t,g, or c
  misc_feature (76)..(76): n equals a,t,g, or c
  misc_feature (486)..(486): n equals a,t,g, or c
ccaggtaccggcccggaaattcttnggtcgacccacgcgtccggcatgacgaacttctcccttgttcccagccnantcctagaatatgttgcctcttctcaaaaataacgtaccacaaagcctctggtgacggtggagcaaaggaatagatggtgaatgtctcatacccacttcggatccagaacaggcctaggagagactcaggtgggatctgctgctgaggaaaggagttggggctgaagttggaggaagagggcagctctaaaccacctattcctggctctaggcctctcaggccagacagcccccacccgtttctgcagatgcccgcatcatggtcctgaggggatgggggctggcctggagcytttcccccgtggtgtgtggctatagcggggacatgaagggggtgtgttggggacgtagtgaccactcccttctaccgtcagaratcctgcttccccctgccccctgcccctyctcggntgtccttcataaccccccacccactccccacctgccatctcctgtgcttgtgcggatccaggaagcacctacctgggcacagagatcatcgctcggtgcctcgcccctacacaagggcgattaa

SEQ ID NO: 3538 - DNA, 659 bp, Homo sapiens
  misc_feature (616)..(616): n equals a,t,g, or c
  misc_feature (620)..(620): n equals a,t,g, or c
  misc_feature (631)..(631): n equals a,t,g, or c
  misc_feature (644)..(644): n equals a,t,g, or c
  misc_feature (649)..(649): n equals a,t,g, or c
ctacgagttttttttttttttttttctgtcagcctcataaacatttttaatgacccacatagcatgacatatacagtatcatgttttccctaagagaaattactttacattgactttaatgacttgccctcacagctttagatttcacttgctaaagtattttgattgtgcatttaatttaaaaagaaacctctaaacatttttttagttgcaaaaaattccaactttaccagggagaagaacattttggggtgttcaactgtactgggaatgttttatttttaagctggttagtgaatacatgggtgttcattttattacctcatatacttcatatgttttaaataataatacatttaaaaatatgctttcttttattcagatttctgatgctagaggaatatgttcagttagtttacttgtcctgaaatttaaacagtaaccatttaaattacgtgagctgtaaagagattggcatttttctgtgagttgttccagacactaggcccagtgctgttaaagatgagccccgcattctctccaaatgacaccaggcccatcattgtgttcctaggctcaagctcttctccgctggcatgatgctcatcaggtctanagcncaaaaggaganttcggtgggtagnggggnggatagattt

SEQ ID NO: 3539 - DNA, 189 bp, Homo sapiens
gaaagaatggctcctctgtttataacacacccaacaggaatctggggtcaatgtgatgagaggcacaaagcttgtggcctccctacaaacaaatgcctacatgtgaagaggaaaaaaaattatagaatctgggtagtgggtgtatgggtgttcactgtataattctttcaacaatctcctatgtttgaa

SEQ ID NO: 3540 - DNA, 637 bp, Homo sapiens
  misc_feature (358)..(358): n equals a,t,g, or c
  misc_feature (523)..(523): n equals a,t,g, or c
  misc_feature (552)..(552): n equals a,t,g, or c
  misc_feature (589)..(589): n equals a,t,g, or c
ttttatatatatatatatatatatatataaaatgccagaaagcagttttcttgacatgatagaaaagaatgtgcttgggaattcaagctctatagcaacaagacagagaagattgtattagtaagattgtatatcttccagtgtcacctgtatatcccctaaactcctcacctatatcacaaaaacctgccaaggcagaatacattcccttgggaaaggagctttggcgggcaagcaggcatcgggtcccatctgacaccagcgtgatcgccacaggagccatctaggaaaggggaatggaaactgagatgctggcactttgggccctgccaatgagctaaagcagtgtataattaangaattgcacaggcttccttccccaggacaaagcagcgcacagtcttcttggattactgtcctcttacagcaataattacctgtggataatagattatattattggaagggcacacacgcttgctgccagccacgtcttcttggtgggctgccacttctgctgcanaactgatgagcatcatgccaccggagaanacttgagcctaggacaacatgatgggcctggtgtcanttggagagaatgcgggctcatctttacagccttgggcctaatggctgc

SEQ ID NO: 3541 - DNA, 813 bp, Homo sapiens
ggcacgagatcattttctgtcccctcctatcttaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctggtgactgaggggaggaaagaatgggagggggtattcttgtctagtggatggaaaggaaacacactgtcaaattactatatctccttggttttctattacagtagaattctccagccatatttttattgtctatgggggaagttggagatggtgaccttgattagaagtgtctggagggggataaatggaggggataagatttcagttggttttggaaaatgttaaagtcttaaaataatgcgtcccatctgaagaattttttctaaaaccagagtttataaaaatatcactgatacagcctgccccctcatttccctgccacaggagatgtcttggactagagacacttgtttaataatagcttgtctctgatattcccagtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttgtctatactaaaaaaaaaaaaaaaaaa

SEQ ID NO: 3542 - DNA, 1025 bp, Homo sapiens
cctggcccacattgcttcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtaccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagccaaaaaaaaaaaaaa

SEQ ID NO: 3543 - DNA, 2288 bp, Homo sapiens
ccacgcgtccgggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggtatcctttctgacccacaaagtatgaaaagttctgtaatctgtaaactcagttctgtaatctgtattattgagatgattaatataaagttgtattttcactgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3544 - DNA, 3758 bp, Homo sapiens
ccacgcgtccgctttttctcaggatgaatattttcctggccgactcattgatccttggtacaaataaacttctggaagacccagagagaggaaaacacaggagaaattgagcgatgtacgtacatcaaataccactactcctcagcaaccatccccaggaacctcactttcaatatcacgaagaccatccgtcaggatgagtggcatgccctacacctgcgcagaatgacggctggcttcatgggcatggcggtggccatcatcctctttggctggatcatcggcgtgctgggctgctgctgggaccgaggccttatgcagtacgtggcaggctgctcttcctcatgggagggaaaacagtggaattaaagagtgtctgccccagcccggcagggtgaagtaggatggggaaaacgttctcaccagaccctgggacttctatgctgcagcatcgtgacctgaggggtggatgcagttgccacagctctttgaggcaaaggccccgatgctctgtggacagcctcaggcttgggatggatttggcagtgaggaacttattgtaacagaagaaagtcatccaagatgcctgaggaaagaaaccttcaattgagccagccggctggaaaatgtggccaagaaaaccgcagagaccaatgttcggaggagaaaaccagaaagaggggcctgcctggcccctttgatcctttatggccgattccgtggacattgctgctcctcacgccggcagccctctcttgagtacctcaattgcagtctccagaccctcaccccgcaggcattcctgggtcggtgtcccagtcggtcacagtcatggatcctctgcagagcagtagaaagtcgggaggggcccgtgcccatggtcaggaaaggagcggcaggaggaaagaggagcatgagaactcagaagaaattgtacctactcagaaggtggagtgaggatagacgttcccagattcaaaggcatcatgaagtgtcatgacaagatagaaaagactttgggctggccaagaaggaactggataaaattatgagtgaggtacagcaggtgggaacagtgtcactgaaccctatcaacagcagagcatgagaacgtgaattcctgctgctggggaggcaatgaaatgatatgggccttcagatgtctatgaatcctgacccaccgtgggtgccagttttcaagagggcttcccatcaaatattgtgcgcaaaggatggatggatgaaaggaagagtgagccaataaacgagggaacgccgggaaaggcagcctcaagccggtgggccctggcacccccaccgtccctgagcatcgagccggttcccgccccggcccgaactggcccgcgcgcgctcgcagccccgcggcggaacccgagggcggcggcagcggttccttgaacgagccggggaatctggagggagcacacaggaaaggcagagccgcgagctggaccagcggcaaatctctagaagatgacgggttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgttttctcaatcctgcagcttgcaaaggaaaagccaggactctatttgaaaaaaatgctgcccgattttacatttatctggcatggatgtgactattgtaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactaaaaaaaaaaaaaaaaaaaaaaaa

SEQ ID NO: 3545 - DNA, 1534 bp, Homo sapiens
  misc_feature (1212)..(1212): n equals a,t,g, or c
tcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggcccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggcttcagcgcttgggagggcaggaaccctggcactaatgctgtacaaggtttttttcctgttaggaagaacttgaggccagctgcccactgagtcttctgtccctgaagaaagggagtattgggcagggcttgggatccggctactgagagtgggagagtgggagacagaggaaggaagatggagattggaagtgagcaaatgtgaaaaattcctctttgaacctggcagatgcagctaaactctgcagtagtgtttggagactgtganagggagtgtgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagacaaaaaaaaaaaaaaaaa

SEQ ID NO: 3546 - DNA, 2664 bp, Homo sapiens
ggttgctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcatgacggatctaagcctttcccacgttatggttataaaccctccccaccgaatggatgtggctctccactgtttggtgttcatcttaacattggtatcccttccctgacaaagtgttgcaaccaacacgacaggtgctatgaracctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacataacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttmcaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttamcctaatatatcaaggcactatttgctgttatgctttgttatttatttcccagcacttgttccttattgtagattttttaaagactgtaaccttttactaactgtggtcttactaaaatttgtgcttgatactgcttttcaaaaagcctttaattagagccaaaaggatggaaaaggcaagatataaatgccttttatagatctcttatttacattgaaaattattaccatatgtttagagcaaatccaagaaaacttcaacagcttctgaagatgtctatgaatgttgaaaacttttcaatctcttggaatgctcagttatgttcctagaccggtctttgctgactactggttgttaacctttccctagcctgggacctcaagccatatatatcctttgggtgacccatggccaaagttattaagatgaactgactttcaaagtcagagaaggacagcatagggagaggcggttatttgtaagtcattacaggtagaacagggcagaaggaaaagtatgttctggagaaagggccatgttcctaactttggagatatgtcattgccgggaacctagtatcttccaacttgaattggtggcagctgttccagtgagacaaggcacatgtatgccttgtggctaagtgagcaaactgggtttccacttaaatgtttgggaccctcaattgattctttatttcaaacctttataaaaggtacagttttgtaagccattattaataattaatgcttatcggctgggcacagtggctcacacctataatcccagcacttgggaggctgaggcggttggatcacttgaggtcaggagtttgagaccagctggccaacatggtgaaacagcgtctctactaaaaatacaaaaatttgccgggcgtggtggcgcatgcttatagtctcagctactcaggaagctgaggtacgagaatcacttgaacccaggaggtggaggttgcagtgagctgagattgtgccactgcactgcagcctggctcgag

SEQ ID NO: 3547 - DNA, 1508 bp, Homo sapiens
ggcacagagatagagcggcaacctcggaagtgcggacgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggagcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggagggtctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaacttaaaaaaaaaaaaaaaaaaaaaaaaaaaaaaaaaaaaaaaaaactcgag

SEQ ID NO: 3548 - DNA, 1412 bp, Homo sapiens
  misc_feature (1362)..(1362): n equals a,t,g, or c
  misc_feature (1369)..(1369): n equals a,t,g, or c
  misc_feature (1397)..(1397): n equals a,t,g, or c
cccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcaytatgctgagcttacactaattggtcagacatgctgtctgccctcatgaaattggctccaaatgawtgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtctgcaaaagaaaagtctaggttttaaggctgtgccagaacccatcccaataaagagaccgagtctgaagtcacattgtaaatctagtgtaggagacttggagtcaggcagtgagactggtggggcacggggggcantgggtantgtaaaccttttaaagatggttaattcntcattagtgtttttt

SEQ ID NO: 3549 - DNA, 1306 bp, Homo sapiens
  misc_feature (1300)..(1300): n equals a,t,g, or c
aattcccgggtcgacccacgcgtccggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggargargaggargaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaaaaaaaaaaaaanactcga

SEQ ID NO: 3550 - DNA, 546 bp, Homo sapiens
  misc_feature (523)..(523): n equals a,t,g, or c
  misc_feature (542)..(542): n equals a,t,g, or c
ggcacgagcaagtattccctgtgttctctccagtaatttcagctggttcctttttatgccctcttgacacagtcacattctacagtgtacagaaaataacctgctgtctgtagaagtggtgaatggtttcatgattcccttctttttagtgtgggtgagttttcttcactctttttctgttgcctgcatccttggccatcatgaatgttttgctttctctcttgcagatgacacaattggtactgcctggcatggtggaaaggtgagtcacaagctcacatacaaacactgtggaagcagagctcatgattatttagagggagaatccttgctttgaaaaaatcactgaagtgactaatgaaccaagcctccatgtcttagccacagagtgatgtaccaggcgagtcacagtagagcatgagtcatcggtggtggaggccttttccactcgattccctttttattctctctctagggttgtagtggttcyttagatcaggatgaaaaarcctgcctgagtcancatcactaaactcaattgnctac

SEQ ID NO: 3551 - DNA, 859 bp, Homo sapiens
ctcgagttttttttttttttttttttttttttttttttttttttttttgagacagggtctcgctctgttgcccaggctggagtgcagtggcactatcttggctcactgcgaccaatgcctcccagggttcaagtgattcttgtgcctaagccacctgagtagctgggattatagctgtgtgccaccacgcccagctaatgtttttgtacttttagtagagatgaggtcttgccatgttgrccaggctggtcttgaattcctggcctcaagtgattcacccacctcagcctcccaaagtgctgggattataggcgtgaaccactgcgcccagcttcaacttgatttcttaaaaggcaaggatccaactcatccttgagacgcttgactaaatgaatgcctattgaatggatggactctccttttttgcattgcctttatgtaatgctccagctgtgatcatggctgtcaggtctacagagatagcagtgaagttcccagcttcttggttttgtattatttactaactgtatagcttcatagcactccatctctttgggcctctattttttcatctgtcaaaggagggaagttactgtcaattaatttaatgcactggatttctgtgactctttgactctaagactttatgctgtaaaatgattttgcaaccattatctcttttgatatggttttcatcaacataattaaaaattccttttacaatacctctgtggtttataagtgtttcttttyyaatgsatagatttactattctgaaccaataccatgttacctgcagatgtcaaaactaggattaaggtgatggcccggcgggatccctaactaaattggaaggttc

SEQ ID NO: 3552 - DNA, 1649 bp, Homo sapiens
  misc_feature (20)..(20): n equals a,t,g, or c
  misc_feature (33)..(33): n equals a,t,g, or c
  misc_feature (678)..(678): n equals a,t,g, or c
  misc_feature (1632)..(1632): n equals a,t,g, or c
  misc_feature (1639)..(1639): n equals a,t,g, or c
  misc_feature (1642)..(1642): n equals a,t,g, or c
aaaaaaaaaaagcttcagtntcctctatgggancaaaccctgaagtgactaatgaaccaagcctccatgtcttagccacagwktgwtgtwycaggcgagtcacagtagagcatgagtcatcggtggtggaggccttttccactcgattccctttttatttctctctctagggttgtagtggttcctttagatcaggatgaaaaagcctgcctgagtcaccatcactaactyaattgcctactattctgagggggcggatagagttyctgggatattcccgggaataccttcyyaaagctgtattctctcaaagccaaaatcagtggagttggatgaagcaagacctcttcctctggtttttcactttttactgggagaatggctgttatataaagtgattataagatgtcaaaccaacccttggaggaaaaggcaatgtccactcgccccatctttgttccagtttgaattggttctgctagtacatgccgaatgtcttcattttgattgagaaatatgttgtagatttctgktatctgaaatagcatgaagtgtagaattgtaattaagctgkttcttccttggaaaaatctgaatgatgtctaggccttcaaagaaaagctgctaaaaagawttgggcttgcatcctgagctagctcgatcatttgctgaatttanggcatcgtagtcatctttttttctgcaaaataactatgagtttggaagagacccagaggaatcacagctttgaaaagggaagacccaaggaccctacttctgttaggaaacctctatgacctactccaggcagggattacagcttatgtttattgagtatatagtaagtgccaggaacttagtaagtgytaactcatttaactttgatagcctcccaccattgtacagatgaggaaactgaggttaggaatccatttgttgagcatctacagggactagttaagaamcagtttctcagcaaagctccttgtaatcccattttatatacactattttgtgtattttaattgttttattttagtaacacttccctttaaaatcttcaaactgcctattgttaggtgccagtgggagtggacccctgatggtcagatatataaatggcagtggttagaccagaccagaaccctagaagatggtagagttggggcaaagtagaacccaggagggattaaatttgggccatcaccttaatcctagttttgacatctgcaggtaacatggtattggktcagaatagtaaatctatccattaaaaaagraacacttatwaaccacagaggtwttgtaaaaggaattttwaattatgktgatgaaaaccatwtcaaaagagataatggttgcaaaatcattttacagcataaagkcttaragtcaaagagtcmcagaaatccagtgcattaaattaattgacagtaacttccctcctttgacagatgaaaaaatagaggcccaaagagatggagtgctatgaagctatacagttagtaaataatacaaaaccaagaagctgggaacttcactgctatctctgtagacctgacagccatgatcacagctggagcataacataaaggcaatgcaaaaaaggagagtccatccattcaataggcnggcaggntgncctaaaa

SEQ ID NO: 3553 - DNA, 675 bp, Homo sapiens
  misc_feature (335)..(335): n equals a,t,g, or c
  misc_feature (496)..(496): n equals a,t,g, or c
cgccccgacttrgagagggtgcggccctgggraccccccctccccgagtgtgcccaggaactcagagagggcgcggcccccgggattcccccccgagggtgcccaggactcggaaggggcgccccggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccggaaagggggctccgagggggcgcagctcaaaaccctgcctttcctttacttttacttttttttttttttnctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccncccttcggttctttcgaccggtcccccctcccttttttgttctgttttgttttgttttgctacgagtccacattcctgtttgtaatccttggttcgcccggttttctgttttcagtaaagtctcgttacgccaaaaacctcgtgccgaatttttggggctcgaggggcaaaatttccca

SEQ ID NO: 3554 - DNA, 751 bp, Homo sapiens
  misc_feature (193)..(193): n equals a,t,g, or c
  misc_feature (339)..(339): n equals a,t,g, or c
  misc_feature (709)..(709): n equals a,t,g, or c
atcgacccacgcgtccggccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagsngctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagntcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtcttcggntgccccttttgttacaccgcgccgcggaaaggggggttccga

SEQ ID NO: 3555 - DNA, 1076 bp, Homo sapiens
  misc_feature (1029)..(1029): n equals a,t,g, or c
  misc_feature (1037)..(1037): n equals a,t,g, or c
  misc_feature (1040)..(1040): n equals a,t,g, or c
ggcacgaggggaaagccatgctcccaggactccttccttgcagccttaaatcggtctgtacggaaaattccgcgccttagaaacccacgcttgggtgtaacttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctgaaaaaaaaaaaaaaaanaraaaacncgngggggggcccggaacccaattcsccggatagtgagt

SEQ ID NO: 3556 - DNA, 729 bp, Homo sapiens
  misc_feature (702)..(702): n equals a,t,g, or c
  misc_feature (710)..(710): n equals a,t,g, or c
gctggccctcgccttcaagctggacgaggtggccgccgtggcggtgctcctgtgtggctgctgtcccggcggcaatctctccaatcttatgtccctgctggttgacggcgacatgaacctcagcatcatcatgaccatctcctccacgcttctggccctcgtcttgatgcccctgtgcctgtggatctacagctgggcttggatcaacacccctatcgtgcagttactacccctagggaccgtgaccctgactctctgcagcactctcatacctatcgggttgggcgtcttcattcgctacaaatacagccgggtggctgactacattgtgaaggtttccctgtggtctctgctagtgactctggtggtccttttcataatgaccggcactatgttaggacctgaactgctggcaagtatccctgcagctgtttatgtgatagcaatttttatgcctttggcaggctacgcttcaggttatggtttagctactctcttccatcttccacccaactgcaagaggactgtatgtctggaaacaggtagtcagaatgtgcagctctgtacagccattctaaaactggcctttcaccgaattyataggaagcatgkacatgkttcctttgctgkatgcacttttycagtctgcaraascggggatttttgktttaatctataaaakgtatggaartgaaatgttgnaccaagcnagaatccttttagattaaa

SEQ ID NO: 3557 - DNA, 943 bp, Homo sapiens
ggcacgagctccgcccggccccgaggggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcaccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccaaaaaaaaaaaaaaaaaaaaaaaaaaaaa

SEQ ID NO: 3558 - DNA, 941 bp, Homo sapiens
ggcacgagcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacccgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgaaaaaaaaaaaaaaaaaaaaaaaaaaaaaaaaaaaaaaaaaaaaaaaaaaaaaaaaaaaaa

SEQ ID NO: 3559 - DNA, 988 bp, Homo sapiens
ggcagcagccaccgccgcgtccctctctccacgaggctgccggcttaggacccccagctccgacgtaagtccctctcgcgcgccacctccatccgctgcccctctgcccacgggccgggctcasatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaaccygctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgytaagacaaaaagtaaagcactgtggtctttgcaaaaaaaaaaaaaaaaaaaaaaaaaaaaaaaaaaaaaaaaaaaaaaaaaaaaaaactcgag

SEQ ID NO: 3560 - DNA, 1172 bp, Homo sapiens
  misc_feature (904)..(904): n equals a,t,g, or c
ggcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggagcatccctgtgctgggcagcctggtgaacaccgtcctgaagcacrtcatctggctgaaggtcatcacagytaacatcctccagctgcaggtgaagccctcggccaatgamcaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgaratcatccactccatcctgctgccgaaccagaatggcaanttaagactggggtcccagtgtcattggtgaaggccttgggattcgaggcagctgagtcctcactgaccaaggatgcccttgtgcttactccagcctccttgtggaaacccasctctcctgtctcccagtgaagacttggatggcagccatcagggaargctgggtcccagctgggartatgggtgtgagctctatagaccatccctctctgcaatcaataaacacttgcctgtgaaaaaaaaaaaaaaaaaaaaaaaaaaaaaaaaaa

SEQ ID NO: 3561 - DNA, 1566 bp, Homo sapiens
cgcgtccggcgcccggcagctgtccaccgatcccggccaccgcccccggccacccccaccccgcgagcccatggaggctccgggaccccgcgccttgcggactgcgctctgtggcggctgttgctgcctcctcctatgtgcccagctggctgtggctggtaaaggagctcgaggctttgggaggggagccctgatccgcctgaatatctggccggcggtccaaggggcctgcaaacagctggaggtctgtgagcactgcgtggagggagacagagcgcgcaatctctccagctgcatgtgggagcagtgccggccagaggagccaggacactgtgtggcccaatctgaggtggtcaaggaaggttgctccatctacaaccgctcagaggcatgtccagctgctcaccaccaccccacctatgaaccgaagacagtcacaacagggagccccccagtccctgaggcccacagccctggatttgacggggccagctttatcggaggtgtcgtgctggtgttgagcctacaggcggtggctttctttgtgctgcacttcctcaaggccaaggacagcacctaccagacgctgtgagtacctggccagcagcaagtacctgagtcccagctcacctcctggttcctgccccaccgttccccttcagtacccagggtgctgtcttctccatgggcaagccctcaggacggtgacagcgtgctccatgtgagccacaccccttttgtctcctccagttggggtgtttcctttgtcagatgttggctgggaccaggactcagcctgggccagtctaggagcccagctgagccctcctgtgtcttttcccttcatgctgccagcagggaagagaaccagtaggtgccagcccaggcaagcctgtggcccgcgtttctgtggctgtgggcaggagctgggccttgtgtctagttgggttttgctctgagaaggggagctgtgcctgaggccctctgtgtgccgtgtgtgctgtggggcgggtcgccacagcctgtgttaaagtgtttgctcttcctctgctgcctcctctcgaggcagggggtccttggctggctgaggcagtgtcaccttcctgagtgtcctctttggcctctgcagaatctgacccctttgggcctggactccatcctgagggcaaaggaggatgcagagggtggcctctgggcacccttgtgggtaagcggggggcgggggcgggaaaaactctggccgccagtttttggctcctgcgggcaccaagcaggctcagtgtctgatgcctgacatctcctcctgtcctgggcctggaacctgcagctgagaaaatccctcaaccacctcgtctcctccatcgcccctgctgggccccccagcctgacagtgggttgtatgcctgcctctttccaccaactggcctgggcactgcccccaaataaaggaactctgcactgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3562 - DNA, 1067 bp, Homo sapiens
taccggtccggaattcccgggtcgacccacgcgtccggcgcccggcagctgtccaccgatcccggccaccgyccccggccacccccaccccgcgagcccatggaggctccgggaccccgcgccttgcggactgcgctctgtggcggctgttgctgcctcctcctatgtgcccagctggctgtggctggtaaaggagctcgaggctttgggaggggagccctgatccgcctgaatatctggccggcggtccaaggggcctgcaaacagctggaggtctgtgagcactgcgtggagggagacagagcgcgcaatctctccagctgcatgtgggagcagtgccggccagaggagccaggacactgtgtggcccaatctgaggtggtcaaggaaggttgctccatctacaaccgctcagaggcatgtccagctgctcaccaccaccccacctatgaaccgaagacagtcacaacagggagccccccagtccctgaggcccacagccctggatttgackgggccagctttatcggaggtgtcgtgctggtgttgagcctacaggcggtggctttctttgtgctgacttcctcaaggccaaggacagcacctaccagacgctgtgagtacctggccagcagcaagtacctgagtcccagctcacytctggttcctgcccacgttcccttcagtacccagggtgctgtcttctccactggcaagccctcaggacggtgacagcgtgctycatgtgagccacaccccttttgtctyctccagttggggtgtttcctttgtcagatgttggctgggaccaggactcagcctgggccagtctaggagcccagctgagccctcctgtgtcttttcccttcatgctgccagcagggaagagaaccagtaggtgccagcccagcaacctgtggcccgcgtttctgtggctgtgggcaggagctgggccttgtgtctagttgggttttgctctgagaaggggagctgtgctgaggccctctgtgtgccgtgtgtgctgtggggcgggtcgccacagcctgtgttaaagtgtttgctcttcc

SEQ ID NO: 3563 - DNA, 1021 bp, Homo sapiens
ggcacgaggattctaggacagggatgggggtgcagcactgatccaggacccagaatggaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggcccccttcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaaaaaaaaaaaaaaaaaa

SEQ ID NO: 3564 - DNA, 1086 bp, Homo sapiens
ggattctaggacagggatgggggtgcagcactgatccagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaaaaaaaaaaaaaaaaaaaaaaaaaaaaaaaaaaaaaaaaaaaaaactcgagggggggcccggtacccaattcgccgtataatgag

SEQ ID NO: 3565 - DNA, 1352 bp, Homo sapiens
gcgtccgcttcacagtttcaccttcaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggacggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcctctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgaaaaaaaaaaaaaaaaaaaaaaaaaaaaaaaaaaaaaaaaaaaa

SEQ ID NO: 3566 - DNA, 1337 bp, Homo sapiens
  misc_feature (1337)..(1337): n equals a,t,g, or c
gcttcacagtttcaccttcaggctcaaarctggstctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggmcggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtccyctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgaaaaaaaaaaaaaaaaaaaaaaaaaaaaaaaaaan

SEQ ID NO: 3567 - DNA, 2092 bp, Homo sapiens
  misc_feature (637)..(637): n equals a,t,g, or c
gaattcggcayggcgacctttgtgagcgagctggaggcggccaagaagaacttaagcgaggccctgggggacaacgtgaaacaatactgggctaacctaaagctgtggttcaagcagaagatcagcaaagaggagtttgaccttgaagctcatagacttctcacacaggataatgtccattctcacaatgatttcctcctggccattctcacgcgttgtcagattttggtttctacaccagatggtgctggatctttgccttggccagggggttccgcagcaaaacctgggaaaacccaagggaaagaaaaagctttcttctgttcgtcagaaatttgatcatagattccagcctcaaaatcctctctcaggagcccagcaatttgtggcaaaggatccccaagatgatgacgacttgaaactttgttcccacacaatgatgcttcccactcgaggccagcttgaagggagaatgatagtgactgcttatgagcatgggctggacaatgtcaccgaggaggctgtttcagctgttgtctatgctgtggagaatcaccttaaagatatactgacgtcagttgtgtcaagaaggaaagcttatcggttacgagatggtcattttaaatatgcctttggnagtaacgtgaccccgcagccatacctgaagaatagtgtagtagcttacaacaacttaatagaaagccctccagcttttactgctccctgtgctggtcagaatccagcttctcacccaccccctgatgatgctgagcagcaggctgcactcctgctggcatgctccggagacactctacctgcatctttgcctccggtgaacatgtacgatctttttgaagctttgcaggtgcacagggaagtcatccctacacatactgtctatgctcttaacattgaaaggatcatcacgaaactctggcatccaaatcatgaagagctgcagcaagacaaagttcaccgccagcgcttggcagccaaggaggggcttttgctgtgctaaattaggatttgagggtgtgggaccctcaccraattcattgattactgaaaattgaatgttttttgggtccacatttcaaggctgaagtgtgtagtgtatatataacctttcctatggaaatgtgacattgagtacattttgtgttgctgttgtgaagccattaatataaatctttggtaatgacccatatctctatatgtatgtgttcccagttgtgggagcaggcactaatgaaatcctgtgcctggaatggagatatttaggtacctgaggcttagtgtcctgtggtctgcatgtaagatagatgacatcctagaacaaagaagctgttttaacttaatccccctgatcagcaggatatctgtgtgttcagtgacatcatacattctgtatctagaagtctaaaatttctgcctttctcctaaagaatgtgttcttgcattttggttgaaataacctacacagtgttaaaaatcagatacctcctttagtgaccagttcaaattttaatagcgataggtagcccctgagaaatttatcactataactccacaggaaatatgacttggaagtgctctgtgtactaaacaaaataaagcccctctttgcatttaaaaccaaagtcaaaacaaaactcttgtaatgcaattaattaacttyatgtcttcccatgactcaagttttgttaaatatgcccaaaaactttgattggcagtttcttcggttaattattcctatagaatgtattttaagaaatctatacaaattggatatatgcttggtaattctccagtttctaggaggtacctatttctaccgtttcaagtgatgaagtgaaaataatttacattcgatagtgttactgataacaaacctacttaagagatatgttgctttttacttaagggatagtgttgatagataaattagaatgtatagataggtttgtgaaagtctaaataatggctgtatagatatgtatatatggttcacayatctggatctgtgtatttgattttgtactttaaatgtgacaaataaaccttttgggagaaaaaaaaaaaaaaaaaactc

SEQ ID NO: 3568 - DNA, 2078 bp, Homo sapiens
  misc_feature (1177)..(1177): n equals a,t,g, or c
  misc_feature (1187)..(1187): n equals a,t,g, or c
  misc_feature (2057)..(2057): n equals a,t,g, or c
ggcacgaggagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgcyctgcatcacaaacacgacaagaggaagcgtcaggggaagaatgcacccccaggaggtgatgagccactggmagagacagagagtgaaagcgaggcagagctggctggcttctccccagtggtggatgtgaagaaaacagcattggccttggccatttacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtccccccmagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctytggtacatcagaccaagaagctcaggccgtggcagagccatgagnccagccgttnaggaaggagctgcaggcacagtagggcttcttggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaaaaaaaaaaaaaaaaattnctgcggtccgcaagggaattc

SEQ ID NO: 3569 - DNA, 2494 bp, Homo sapiens
  misc_feature (920)..(920): n equals a,t,g, or c
ggagatgtttaaggattacccgccagccataaaaccatcctacgatgtgctgctgctgctgctgctgctagtsytcctsctgcaggccggcctcaacacgggcaccgccatccagtgygtgcgcttcaaggtcagtgcaaggctgcagggtgcatcctgggacacccagaacggcccgcaggagcgcctggctggggaggtggccaggagccccctgaaggagttcracaaggagaaagcctggagagccgtcgtggtgcaaatggcccagtgacccccagacgcggaaaccgggtggcagckcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctccaggtgaaatncacaccagtccacgccgggtcgcctgccctgtctccctacttagacccagtcattctagagggatccamcgccamactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagtggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtgaaaaaaaaaaaaaaaaaaaaaaaactcga

SEQ ID NO: 3570 - DNA, 1957 bp, Homo sapiens
cctagctgtccccctgagatgaagaaagagctccctgttgacagctgcctgccccgctcactcgagcttcaccctcagaagatggatcccaagagacagcacattcagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctaaaaaaaaaaaaaaaaaaaaaaaaaaaaaaaaaaaaaaaaaaaaaaaaaaaaaaaaaaaaaaaaaaaaaaaaaaa

SEQ ID NO: 3571 - DNA, 730 bp, Homo sapiens
gtgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcatgccacgtcacaggccatgcaccagctcttcgggctgtttgtcacactgatgtttgcctctgtgggcgggggccttggaggcatcatattggtcttatgacctcctagacccctgtgccctgtggcatgggtggcamcctcctccatggtggggggcagagaagcctcacagatcctcccctaccaccaccagggctcctgctgaagctaccctttctggactccccccccagactcccagcactac

SEQ ID NO: 3572 - DNA, 550 bp, Homo sapiens
  misc_feature (76)..(76): n equals a,t,g, or c
cagacttcccagcactacgaggaccaagttcactggcaggtgcctggcgagcatgaggataaagcccagagacctntgagggtggaggaggcagacactcaggcctaacccaytgccagcccctgagrggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaaaaaaaaaaaaaaaaaaaaaaaaaaactcgagggggggcccgtacccaatcgcctaagatgtatgctat

SEQ ID NO: 3573 - DNA, 807 bp, Homo sapiens
cccacgcgtccggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccggttcagctttgaatggaacaacgcttattttggaagttcgaaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtaaaaaaaaaaaaaaaaa

SEQ ID NO: 3574 - DNA, 946 bp, Homo sapiens
ggcacgagtgagattgcatccagacagagttttaaaagtttcccggttgagtttaatgtacagttgaagttgagacatgaatctctgcatgtaggggaaattttgtgtctggttagtcaagaaactatggaaaccaattcttgatattttgaaccattcacgaagatagtttgagtcatgagcatgctgttgtctagagtgggcggggatgactcattggagtggatgcgctgctctgtacttgatttttttgagtctgaaattagctttccaggctggggcagggaggggagcacaggtgggatcagtactgcccccaagcggtggagctgtggtggtggatcaatactgctgccgcctgtctgcacaaacatatttctctcttccagcccttcagaagtgtattggaatatgtcgataacaataatgatggtagtgaagatgatgatgatgtgggtaattctggctaccttattgggtccaagctccccacaattcgttgcacaaagcactctacatacattctctttagtcctgatcaaaccacctttcagagtaggatttagtgtcctattttaaagatgaaggagctcgggctcagagagagatcgtttagacacacacacaactttggaatgaaacatttacagccgggcgcggtggcgcgtgcctgtagtcccagctacttgggaggctgaggctggaggatcgcttgagtccaggagttctgggctgtagtgcgctatgccgatcgggtgtccgcactaagtttggcatcaatatggtgacctcccgggagtggaggaccaccaggttgcctaaggaggggtgaaccggtccaggtcggaatgaaacatttacaaaaattgacatttccttatgcatagatatttcactaggtccttaaaacccacgtgaatctgtgattaaaaaaaaaaaaaaaaaa

SEQ ID NO: 3575 - DNA, 845 bp, Homo sapiens
  misc_feature (1)..(1): n equals a,t,g, or c
  misc_feature (4)..(5): n equals a,t,g, or c
  misc_feature (823)..(823): n equals a,t,g, or c
  misc_feature (845)..(845): n equals a,t,g, or c
ntanntaatggcacatctccccttctattgggaacacaagctggagctccaccgcggtggcggccgctctagaactagtggatcccccgggctgcaggaattcggcacgaggtcaaggcaaaaatgggtcaggtttggagagttcccccactccttttgagtgttcaggttttccttaccatggctcatgctttccatcaagcaccagagttgcagtggcttggcctctggttctgggtgaggttatttgcaggtggagacggggggctgcacctgaacatttctagtgtcaccctccctctccttcatgggaaacagctctccagggaagtaccttcctgccaggggaagccaaggctgggccggccgccctacaaggagccacaggattgcagccatgggtgccacctttcatggaaggggagatttatgggctttcctggaacccccaggctgtcctggccaagaggaaagaggtggttacttcaggagtttgaccttagttagataactaaaagaatacatttcccctcccttttctttatttcctcaataaaaatgtacaaagtatcacccttctccatgccccaatctgtgttaaagtcacaatctatgggtgtagttctgggattctgtcaaattctccttcctgctctccaaaatggacaattgtcgtagggaccacatgcccccagaatacaatggcctctgtgktctactggggtcaagcctgctagaactcagcattcatgacaggggstaagtgtgcatgaaktgacactgactacagstargaaagccaggcgcacaaatgsccctttcnccccaagggccggtctttccan

SEQ ID NO: 3576 - DNA, 738 bp, Homo sapiens
  misc_feature (3)..(3): n equals a,t,g, or c
  misc_feature (8)..(8): n equals a,t,g, or c
  misc_feature (566)..(566): n equals a,t,g, or c
  misc_feature (680)..(680): n equals a,t,g, or c
  misc_feature (684)..(684): n equals a,t,g, or c
  misc_feature (703)..(703): n equals a,t,g, or c
  misc_feature (715)..(715): n equals a,t,g, or c
  misc_feature (717)..(717): n equals a,t,g, or c
  misc_feature (731)..(731): n equals a,t,g, or c
ccnctgtnctggccctctatcatttgcctgcctttagacctgcctcaaggatatggcagcgctagcctttagctyccacagcacggatgggggtgatgccagttagaagtgggtagtgaacgtttgctgagctgttcactgtttmtctcttctctttggaagcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcratccatgagggactcctcctgtggaaaaggagagctgttccagaacacagaactgatctcaggtttttgaaaaaaaaaaaaaaaaaactcgagggggggcccggtacccaattcgccctatagtgagtcgnattacaattcactggcgtcgttttacaacgtcgtgactgggaaaaccctggcgttacccaacttaatcgccttgcagcacatccccctttcgccagctggcgtaataagcgaanaggnccggaccgatcggcctttnccaacagttggngnagcctgaaatgggngaatggg

SEQ ID NO: 3577 - DNA, 869 bp, Homo sapiens
  misc_feature (765)..(765): n equals a,t,g, or c
  misc_feature (800)..(800): n equals a,t,g, or c
  misc_feature (847)..(847): n equals a,t,g, or c
ggacaagccatgtgccagacctagtcaacctgtctctcaatgacaacgatggctccagtggggcttcagaccaggataccctggctcctctgcctggggccaccccctggcccctgctgcccactttctcctaccagtaccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggytgggccgggcgctcctggtgtgtgactgggtgtcctggccgtcatgtgcttgctcttacantgcctgggctcaagcctaccagctgctgcatacangagattgtgggccactgtgactcttcaccaagcatgcctggttcctnccccccttcccttcaaggggta

SEQ ID NO: 3578 - DNA, 692 bp, Homo sapiens
cccactttctctgaccagtaccttgccccacacccctacagcccgcagcctccaccataccatgagcttccacatgsccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactcaaaaaaaaaaaaaaaaaaaaaaaaaaaaaaaaaaaaaaaaaaaaaaaaaaa

SEQ ID NO: 3579 - DNA, 2333 bp, Homo sapiens
  misc_feature (2018)..(2018): n equals a,t,g, or c
  misc_feature (2044)..(2044): n equals a,t,g, or c
  misc_feature (2292)..(2292): n equals a,t,g, or c
  misc_feature (2306)..(2306): n equals a,t,g, or c
  misc_feature (2331)..(2332): n equals a,t,g, or c
cacgcgtccgcattttcgtatccctgctgatttcaaaccttcccatggtttagaagcataacctgtaatgtaatgcaagtcccctaactccctggttgctaacattaacttccttaagtaataatcaatgaaagaaattctatgcatggttttgaaataatgtccttgaaagaggaatcaccattaggaaaggtgagtcagggtcctttgtttaatgtgactagtggctcatcatcaccagtgacctggttgggcctactctccttccagaacctgcattgcttcccagacctccccactgagatgcctctaagagccaaaggagtcaacacttgagcctagggtgggctacaacaaaagattctaatttaccttgcttcatctaggtccaggccccaagtagcttgctgaaggaacttaaaaagtagctgttatttattgtattrtataagctaaaaacatttatttttgttgaatcgaaacaattccatgtagcaatcttttttctgttcacggtgtttgtgatagaaccttaaattccgcaagcatcagttttttgaaaaaatgggaattgaccggatagttacaggcaaagattataaatwgctacaacatcatttaacttttataaacatgccttctctctattgaagacatctgatatttttgctggaaagttggatctatcctcagtaactctgccatggaattcctgkttcctggttccagaaaaagaaaagattacatttctgatcataaagaatgtcttgcatatggggaaatttttcaaaatgaaggggggtattatttatgtgggcatgggaaaacttttgccatggctgtttgtcttagtgggcatcttttgatgamattggatcagatatatgtagatgctgatatatgggacacatgtttaggttttggtgcagttgcacaaaactgtgttagtttatatgttactgtgttgcctttatttattctctccaaagtgtctctttatatttgttttacaatctgtgaaagagtataccataatacagaagtattttcatagtctttacctctggattgtcctgtcagtatagccacgttgatgagattacaccagtgcctttgatcatctttaagtatttgagccctgataaatattttggtaacataatccaaattagagacttagagctctggttagcaatcatgtttaaagagaagcttcttaaagctctgtatgctgggagattcatgattattaccaacgttttgatttcatgaaggtgttctcaaatttaaagcacattttcagtaagaacaaaaatatttaatgtttttatcttagacttaacttgatacatttgcatattactatggaagttattcaccttgtccctgtttttctttaagatattttaaaatcatagttatactacagtccttttttaaatgtatcctgatacattgtaaaatattttaatttcattgtggaaaataatgttggataaggagatatttttcactgttaacttttagcccatgcattttcataatttatttttttcacttgctgctttatatgacatatgtgacatttgattatttaacacttgatgtgatctgcataaacccaagttgcacaaccctcctgctgaagataaaattgaggttaaagataaagatttattttcatatttgtacagtgatcggcttcagtgatggtttttgtgggcatttattgtgtgtgtgtaagaaatttcatatgtatatattaagtaggcctctgagtattgaataattgttttatgattttgatttatatggtttacattttcattgtgtgggccatatttcgtttatactgtttatttctcttcaaaccttaataattataccataaagtgtaatttttatagcaatgcaaatgtctaaggaactacaaatattttctacgttgtaaattcaataaagcttgcttcctttggcaaaaaaaaaaaaaaaaaaaaaaactcgagggggggcccggnacccaattcgccctatagtgagtcgnattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgctaaatcagctcattttttaaaaccccccccccnaaaaaaaatttttnaaaggggggggggcccccccccccnng

SEQ ID NO: 3580 - DNA, 3113 bp, Homo sapiens
gttattaatgaccgctgagcaggcagcaccatgtcagtgtgacaactgaatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaagcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaagcgaaagactgcagttgtgctaaaaacaaaacaaaacaaacaaacaaacaaaaaagtaaaaaaagattactttcgagagagaagtttaagcttcaccaatggctggctcctggaccaatgggaaatatgttacaactttcaggcattttttaagtgaactttttttttttt

SEQ ID NO: 3581 - DNA, 980 bp, Homo sapiens
  misc_feature (1)..(1): n equals a,t,g, or c
  misc_feature (937)..(937): n equals a,t,g, or c
  misc_feature (956)..(956): n equals a,t,g, or c
ncgttcgccagctcgaaattaaccctcactaaagggaacaaaagctggagctcgcgcgcctgcaggtcgacactagtggatccaaagaattcggcacgaggggcgttccatcgaggcctttgatcgcagcatcgacctgctggtgtcgcgcctgcgccagaagctgggggatgaccccaaggctccgcaattgatcaagacggtacgcggcgaaggctacctgttcgacgcccgggatatcggttgatgcgcgcgcccttcaacacgctgttcgggcgactgttcggcctgttgctggtggcgattgtgctggcccatgtgctggcgttcttctggttccaccactacggcccgccgccaccaccccgcgcggccttcgtcgaacaaccagatggcagcctcacgcccttgcgcaaagcgcctcgcccctggttcggcggcccggtggtgcccctgacatttcaatttatctcgctgatcatcgctgcctggtacggcgccaaactgctgagccggccaatccagcgcctgagcgcagcggccgagcgcctgagcgtcgacctcgacagcccgcccctggtggaaaccggccctcgcgaagcacgccaagcggcctcgaccttcaacctgatgcaaaagcgcatccgcgaacaagtcagccagcgcgcacgcatgctcggcgcggtctcccacgacctgcgcaccccgctctcgcgcctcaagttgcgcctggaacaaatcgaagaccccaagctgcaaggccagatgcgccaggacctggacgacatgatcggcatgctcgatgccaccttgagctacctgcacgaacagcgcaccagcgagacacggcattggctcgatgtacaggcgttggtggaatccctgagtgaaaacgcccaggaccaaggccgcgacgtgcagtttttttttggggggnccccccccggggggggggncccaaaaacccccccccctttttt

SEQ ID NO: 3582 - DNA, 888 bp, Homo sapiens
  misc_feature (845)..(845): n equals a,t,g, or c
  misc_feature (864)..(864): n equals a,t,g, or c
ggcacgaggggcgttccatcgaggcctttgatcgcagcatcgacctgctggtgtcgcgcctgcgccagaagctgggggatgaccccaaggctccgcaattgatcaagacggtacgcggcgaaggctacctgttcgacgcccgggatatcggttgatgcgcgcgcccttcaacacgctgttcgggcgactgttcggcctgttgctggtggcgattgtgctggcccatstgctggcgttcttctggttccaccactacggcccgccgccaccacycckygcgkccttcgtcgaacaaccagatggcagyctcacgcccttgcgcaaagcgcctcgcccctggttcggcggcccggtggtgcccctgacatttcaatttatctcgctgatcatcgctgcctggtacggcgccaaactgctgagccggccaatccagcgcctgagcgcagcggccgagcgcctgagcgtcgacctcgacagcccgcccctggtggaaaccggccctcgcgaagcacgccaagcggcctcgaccttcaacctgatgcaaaagcgcatccgcgaacaagtcagccagcgcgcacgcatgctcggcgcggtctcccacgacctgcgcaccccgctctcgcgcctcaagttgcgcctggaacaaatcgaagaccccaagctgcaaggccagatgcgccaggacctggacgacatgatcggcatgctcgatgccaccttgagctacctgcacgaacagcgcaccagcgagacacggcattggctcgatgtacaggcgttggtggaatccctgagtgaaaacgcccaggaccaaggccgcgacgtgcagtttttttttggggggnccccccccggggggggggncccaaaaacccccccccctttttt

SEQ ID NO: 3583 - DNA, 1651 bp, Homo sapiens
  misc_feature (1648)..(1648): n equals a,t,g, or c
ggggacatgtctgggcacaaggaaaggcaagcaatggaggcagcaagagcccttggcagcaagtttccatcacctttgcctgccagtgtgtgagaggcgcagaggggcagtgagcaggtgacatgcagcttccagatacccacacactgcttttctcccgcccagctcccaccccagttaattgagatgggattgtttctctttctggtttcttcctaagcccctctctcatattcctggtgtgcttatggcctggcacaccttgtgaaacagaaacccaagctcctcatttcggagctgggatttcgattggctatctgcctccctaaccaagctgtcccttccacctcatccctagagtcaccctctggtctcatcaacatccagtgggcatttcagyggcccaggatccttcmaattgcagatataaagcatcaggaccccacacctgggatggaagcttctaggaattaatgaagccccagtagaggtgagggtaaacctaaaacgggctggatagggcctctcccaaggccctatggaaaggtgatgggaaactgggggctgaggcctcatcctaggagacccctggagggacccacttaccctagataggcagcggaggccagaaactggaaaacagccactcattgtcggtgcattaccgtgagcaccacctgtagggactctgttggcctccagccgtcgtcacacgttcctgacaaccacaaaagttcatttgagggtgcccagtcagctgactttgcttccaccaggaatacccacctggccctggtccttctgctgagctacaggaggcattcccagggtcttagcaaaaacaacccctcaaataggcccagtgcctacaactctagagaggtttcagatggtattggagacccagagaagttaactgactttcccaaaagtcacccactgtaaatggcagacagatctcaaacccacatctgakcctgagtccagtgttttttctctagtatcatcattgtcccttaaatgtgtttgacacatcatagtttacaaatcaccttcactcatattctctcactactcatcagtcatgaattcagccaatgagaagggctcagagaggttaactaaccagccacgctgtttacatggggcatagactgcttcatgaacgcttgactgcagctttgccttcctcatgccctcaaaaaggaaggagctgaccaaagcttactataccatagctggggtctgggacccccagccaggtctcacagatgatctgggaatggcctccctgttgctctcaggggtccggcagtcacacagaagagtcaggttgaaatcttggcaagactttggtgtggctttgggaactgggtttaacctcttggggacttcaccaagacagtggcaaaggacaccacctacagcttccagtgcctctctactctcccacctgtgctcctggggttgaatgagaccagaagcagctgggacaagatttggaaagataaagagagccaggagacaagaccttgagagaagcasaggtctggctggctgctgscctctggtggcgacaatgggtgacactgtaaacccctctgcaaggcgacactctcccctgactattcaggragggaagaagcanttg

SEQ ID NO: 3584 - DNA, 1746 bp, Homo sapiens
gcgttcgcgcacctccagctcgggccgatgtggaagctttggagagctgaagagggcgcggcggcgctcggcggcgcgctcttcctgctgctcttcgcgctaggggtccgccagctgctgaagcagaggcggccgatgggcttccccccggggccgccggggctgccatttatcggcaacatctattccctggcagcctcatccgagcttccccatgtctacatgagaaagcagagccaggtgtacggagaggtacagccccgacgggccccgggcagggagggccgccaggctggcccgggctggccagggccttcctggttggacttatggccgcccctgggccgactagtcgggacctctccgtgtgccggctgccctttgagggacacccgcttcccgggtctggaagggagaagtcctcgacgccgtgcccccttgcagggggagccccgcccctgccggtgacccactccgggccgaggctccgaggcgatccagtcctgattttcccgctaccgctcgagctcttgctcctgcgcctgcgccgtttggctcgccagccgcgccgccacttcaggtccagggtggacgcatgccctcaggtgcgggcgtcttgcgagtcggcctcgcagctctgtggaagctgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatggtaatgccgttctgactggctgggaacggcaccttagcagatacttaaaaggcgccttctgtgtgccactgtcactgccaacttggtgactcatttaaaactcataaccagccggtgaggtcggtacttcgctcctcctcattctgcggaggggaaagcagcacggaaatgccctgtgactggcagcggaaaaggcgaccaccgcttgtgtgtgggtgtcccgacgtccggagggggcaggagtttccacgggtcctgggacagagctcacctgttttgttttgaattacacttatttatatgcaactacaggcctgacgctagcggtgaagaaggcagatacagccttttaaggagttggcagatgagtgggagagagaaaactaatctcattatcggccacaggctgtggtcagtgttttgaaggaaaagtacagggatgtttggcaactgtggtatttcaggtttgaccttaaatccttacttaaaccagtttttacaaggattggtctaggtgcccgggcgcggtgctcacgcctataatcccagcactttgggaggccgaggcgggcggatcacgaaatcaggagatcgagaccgtcgtggctaacacggtgaaaccccatctctactaaaagaatacaaaaaattggccgggcgtggtggcgggcacctgtggtcccagctattcgggaggctggggcaggagagtggcgtgaacccgggaggcggagctttcagtgagccgagatcgcgccactgcactccagcctgggcaacagagccagactccgtctcaaaaaaaaaaaaaaaaaagggcggccgctctagaggatccaagcttacgtacgcgtgcatgcgacgtcaatagctcttc

SEQ ID NO: 3585 - DNA, 2492 bp, Homo sapiens
ccacgcgtccggaggaaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatgggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaagctcagctccttcttttctgtgcaatacgagacccggccgcaccccgagtcacacaggcccctggggccacggcgttcgtctctcctgtgctgtcctcaggcctccgctcctgttttggtggcccaggctctcccctgccccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgagactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcactaaagtcttatgggcgtcccctggggttgggggggcacaaggttttggaggaagaagacaacttccctcattccatcatcaccatctctttctcactaggttctttctagttttcaaagcaataagtctagcctgccttggacaagggggcccccagttaaacaaactacccatccatgaggtgccaggcagtcaaaaaacagaagcttccccgattgtgagtccatgagatgtgctcttgttgtaaggcatttggggtgacagggagtgacccagaggccaccactgcttttcatgcaggagttacagacactggttttcttggaaaatggagagaagcgcactttgcacagacgtcgtcaattaagtcccaatttgccacttggtattgagtacactggaccctgaccactggcttttgggcaaacgtcttcctcacggggcgcttccgccaagccggcccagctgcacccctcccttcctggagggatggccagggaaggagaaaacagagaactgacacttttgaaaccacagaatgtgtaacatgcagatcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataccctactacaaattggttgaatgtttctgtctgtggtgcgaaccagcattaacggatggggcacgtgcccaactgaggaacaggagaagaaatccccaatttgggctctcagagctaagacacacttattgattctgttgcacattttgcactggtttatggcgattgttttcttggacggatagtgtaaaataaacttctctgttctctaaaaaaaaaaaaaaaaaaaaaaaaaaaaaaaaaaaaaaaaaaaaaaaaaaaaaaaaaaaaaaaaa

SEQ ID NO: 3586 - DNA, 4909 bp, Homo sapiens
  misc_feature (2488)..(2488): n equals a,t,g, or c
  misc_feature (2493)..(2493): n equals a,t,g, or c
  misc_feature (2512)..(2512): n equals a,t,g, or c
  misc_feature (2523)..(2523): n equals a,t,g, or c
gcgtccggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccctcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagatgaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggcccaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagcgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtgaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcanacccnaaaataaggaaaagcttcnatggctactanatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgtctgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3587 - DNA, 1579 bp, Homo sapiens
  misc_feature (1529)..(1529): n equals a,t,g, or c
  misc_feature (1556)..(1556): n equals a,t,g, or c
  misc_feature (1569)..(1569): n equals a,t,g, or c
ggcagagggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctgggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagcctgagccccaytgcaattyctyctagggstgcacawtcatgtggcyttagggcamaytgtyctgcatccagtctgtgtyctyctgtctttctcatccaggtcaggcattgacatttgtaagaaanggggtaagggacacagctgggcaagtngattggttggcangattgctgtc

SEQ ID NO: 3588 - DNA, 587 bp, Homo sapiens
cccacgcgtccgcctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccaaaaaaaaaaaaaaaa

SEQ ID NO: 3589 - DNA, 2191 bp, Homo sapiens
  misc_feature (1327)..(1327): n equals a,t,g, or c
  misc_feature (1334)..(1334): n equals a,t,g, or c
ccttctctaaaaaagcaaacaggcaaaacttcatgagaatcttgatcatgttaaaattttatgtccttcgatttctccctacacacacacacacacacacacacacacacacacacacactcaacatttcctccacccatatcatcactccttagcatctttattccatcaaaactttctaccccttgacattctctgtgcagttttgaaaattaccctctcagcattctctgttcacccccacacctagaccctgacctctagtcaattctactacccaggggtgtccacggttccagcctcctccatgaagcccagttctatgggctcactcctctgggtaagtgggagcccccagctatcatcctcattgtatagaaaaccaactctgtgatgctacctgcccctcttccccttctctcctgaaagagggctggggtagaggtgggaggactggttatggccctggccgggtctgtattcgtactgggaggagtattggtactctgtgtagaaagaaatggggagggggaaatggggtggcctcagcatctccctaagtcccagcctttaagtcctcctgttgcagttcgtcgctgcagcttcgagaggagttggatcgatcttcttgtggaaacgtcctcttcaatggttacctgccgccaacaggtaggcactcccaatggaatggaggggcgcggaggtgggccaaagactacatttcccataaggctgcagctctcgggtgcctgtgctgtgcgtcctgagatacagtgggaagtgtagttccctatcagatgcttgggctgatgcttggaaaggaagttggacacagcatttcccatgaaacaatgggccaactaactcttgaagctcaaaaagatgtccttggaaccccatggggaatttgttatcccgggtttgggtttcttttgttagggggggctttgggaaaaactggggattcctccgtatggaaggggaaaaaatattaaataggaagttattgacattaatgcccatgatagccaccccactgggccatggaaggtatgccccagtgggtattggaactaggcttttctgattggtagaagtaacagagtagggaaatttcatctacagctttatttccctaactgcagtcagcacctgtaccttcatgaaagttgccagatataaagatctgtagtagtacttttccaacttagttttatcctgttttcccgaaaaacaatcatttatttatttatttatttatttaattttatgagacagggtctggctttgtcacccaggctggagtgcagtggtgcgatcttggctncactgcnacctctgcctctcagattcaagccatccttccacctcagctctgccactgagtagctgagactacaagcactcgccaccatgcccggctaattaaaaaaataataatcattttaaatgcaagctttatattataaatacaaagtaaacatgaaaataaaacccaaacatagcagtgttattaaactctggcctgtagcagtggctcacacctgtaatcctagcagtttggaggccgagacaggtggattacttgagacctggagtttgagaccagcccaggtgacacagcaagacctcatctctactaaaaataaaaaaaaattagccaggtgtggtggtatgcacctgtggtcccagctacttaggatgctggagtgcgaggatcgcttgagcccaggaggtcaaggctgcagtgaactatgatcactcattacaccccagcctgggtgacagagcgagatgctgtctcaaaacaaaacaaaacgaaaaacaactctggctagatgctattgcttgccaagggtgcagtcttccatttattaaaagtgaaaattagggccaggcacattggctcatgcctgtaatcccagcactttgggaggctgaggtgggtggatcacctgaggtcaggagttcgagaccagcctggccaacatggtgaaaccttatctctgccaaaaatataaaagattagccatgtgtcgtggtgggtgcttgtaatctcagctacttgggaggctgaggcaggagaatcacttgaacccaggaggcagaggttgcagtgagccaagattgtgccattgcactccagcctgtgcaacgagcgaaactccaactcaaaaaaaaaaaaaaaaaa

SEQ ID NO: 3590 - DNA, 2242 bp, Homo sapiens
tcgacccacgcgtccgggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttytstgwmagtacymtattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaaaaaaaaaaaaaaaaaaaaaaaaaaaaagggcggccgc

SEQ ID NO: 3591 - DNA, 2381 bp, Homo sapiens
ccacgcgtcccgcaaggccagttctagtgtagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaaaaaaaaaaaaaaaaaaaaaaaaaaaaaaaaaaaaaa

SEQ ID NO: 3592 - DNA, 2921 bp, Homo sapiens
ccacgcgtccggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccatgacttcatcatctgtgtggagatgttctttgcagccctggccctgcggcaccccttcacctacaacgtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcgcttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatcccttccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttcccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcatggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctaaaaaaaaaaaaaaaaaaaaaaaaaaaaaaaaaaaaaaaaaaaaagg

SEQ ID NO: 3593 - DNA, 1259 bp, Homo sapiens
  misc_feature (4)..(4): n equals a,t,g, or c
  misc_feature (18)..(18): n equals a,t,g, or c
gggntacaaaagctgganctccaccgcggtggcggccgctctagaactagtggatcccccgggctgcaggaattcggcacgagtccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctatatatgagataatatagattgtattgaaaaaaaaaaaaaaaaaaaaaaaaaaaaactccga

SEQ ID NO: 3594 - DNA, 1931 bp, Homo sapiens
  misc_feature (1212)..(1212): n equals a,t,g, or c
cccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaaggggtggcccaggacgcaggcatcggggctggcgtggactcctactttgagtacttggtgaaaggagccatcctgcttyaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacntctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcaaaaaaaaaaaaaaaaaaaaaaaaaaaaaaaaaaaaaaaaaaaagggcggccgc

SEQ ID NO: 3595 - DNA, 1314 bp, Homo sapiens
atgcggcagctcttctatgaccctgacgagtgcgggctgatgaagaaggggggcttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgagggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagagccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgtgccgcccccgttgatcctcttcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccgagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaagga

SEQ ID NO: 3596 - DNA, 1867 bp, Homo sapiens
cccacgcgtccgggccacagcagagacagtggagggcagtggagaggaccgcgctgtcctgctgtcaccaagagctggagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagttgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaaaaaaaaaaaaaaaaaaaaaaaaaaaaaaaaaaaaaaaaaaaaaaaaaa

SEQ ID NO: 3597 - DNA, 1722 bp, Homo sapiens
  misc_feature (401)..(401): n equals a,t,g, or c
  misc_feature (695)..(695): n equals a,t,g, or c
gggaccgcgctgtcctgctgtcaccaagagctggagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtcaccatcctggaggcagataacaggatcgggggccgcatcttcacctaccgggaccagawyacgggctggattggggagctgggagccatgcgcatgcccagctctcacaggatcctccacaagctctgccagggcctggggctcaacctgaccaagttcacccagtacgacaagaacacgtggacggaggtgcacgaantgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggccnacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgcgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagmcgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaaaaaaaaaaaaaaaaaaaaaaaaaaaaaaaaaaaaaaaaaaaaaaaaaagggcggcc

SEQ ID NO: 3598 - DNA, 1675 bp, Homo sapiens
  misc_feature (1549)..(1549): n equals a,t,g, or c
gtacgacycactatagggwgagagctatgacgtcgcatgcacgcgtaascttgggcccctcgagggatcctctagagcggccgccctttttttttttttttttgaagaataacaattgagttttattctttaaaggcattctctgatttacatgagaattgagaaactgagatgtatgatttgtctgttagtcaatttcacaccctttcattctcataagccccaaattttgctcagttaaggagcttgctttaggcccacctatgtaagtctgttatactagctaatgtgcccatttgaatagttcaagggtcagctaatgctctgagcttcatggctccagtataaagaacaaatttaacaaaattaagctgttactgtagccgagttacccttctgctccacacatatgtagtgggatcttgcaggatttccatagtgccaattatcaaaggccttgactacttagcattgctgtattacagatgtgcaaactgaggcactgaaaagtcaaatttaaagtcatattgagggccagaaaaggaggcttagtttggggctttggccattttagctacttatctgaaattgctgcagatacaacgtatgagcatatcaaatatttttgactgtatataattgatttctaaggtaaaaacaaataaaaagaaaccaataatttttaaaggaaagatgtagttcaaaaaaaaaaccaccattaaacatggtgccattacaggttaaaacaaatgctttgtgacttagacctcaaaaacagagcttgatgactttactccacaatttgtgcacttagtgtatatttaaatgctctctgttaattagaacaacttcattatgctatcaagattccagtaatccataaaacatgtcaattatgatttgagtttgtgcgaagccctgtctgtgagctcatagtctcaatagcctcttctagtacccagaggaagctatagataaaaaataactctattggcaacccatctgtttctgttactggaaatttccacacacctctgcttttggaaatcacttagaaaacttgaggggaaataattccttttgctttcagtctggcagcaagaaggatcctgaaggaattctgtgggtccaggatccagtggggtaattctgtaaagtgcagtagtgcttgcttaaagccataggctccagaggtgagtccagatcagtgaaggggcaagtttcatggccaggtgttggctagtcttgttgcaggtttcagattaaagtgctgggtcatccaaaggcatttgaaaagtgcaaatggcaagctctgcaggccaccgaattcttgttcagagtccagaagcttctttagatgtcatatcaggtcaccctggctcccaagaccacaggttcagatagcactgttcacttccctctttgttgtggtgacaggtctttttgttgtgtcttttgaagaatacagcttttgacagagttgttttcttagggctrtcackgkggctatgaaaatgaaagcaatgatgcaggaggggatgaaaatgtnaagcagccaagttggatgggtcctgggttccatctgactttgaaggtcaatgctggccaaagtaagttccctcacgtgagtattccagaacacacagctgaagtttctgccagggggtggctttag

SEQ ID NO: 3599 - DNA, 786 bp, Homo sapiens
  misc_feature (754)..(754): n equals a,t,g, or c
  misc_feature (778)..(778): n equals a,t,g, or c
ggaatgaacaacttttcttctcttgaatatatcttaacgccaaattttgagtgcttttttgttacccatcctcatatgtcccagctggaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttcccatmcctcaagtycaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagncactccaggacccctgaaggcctntaccaggt

SEQ ID NO: 3600 - DNA, 2042 bp, Homo sapiens
  misc_feature (2001)..(2001): n equals a,t,g, or c
ggtcagctttcatctcgtcctatctttgttcaggcaaacttctctagttctgttttaataggcatatttgttaggtctgttttttgaaatcctcttttttacattgtttaaagataatgccttggctaaaaagcctgcttcacttttccctgtttttagttgttttctccacattggcagtaaagagccttggcgtcccagtagcagcaggttctcctttttgtattgtggatgttttgcatttcatactgttgtgaagagtggctttgatcatacatgttgttggtatatttgccyttttgctgggggtgtgagaagaaccagagatgagcagaggtacacccagtagacttcccagcctgcagagcctcccgggaagagcttccgtgttcaggtgcttggggccccwccctaggagcctgwctcwcagtcagagcwgggtcccggcttgygttcaggattttgaaacatttgtawggtgattttgttgtttctacacctttctcctcatctttttttttttgtagttaatcgttactaataacagaaaagacatttttggcatggtaattggcacaaagtgaataattgttgaatagatgacttttgaggctttcaaaattcgagtgtccataaaatccatccagagccacctggttcctttttttgaaccacttaacgtaattctggaaaaccttgactgtgggtcttaagtttggtggattgctgcttctcactggctgacctttggaggtcgcatatttcaggatgtgattccacttaggctccatttcacctgacactgcaattctgtgccttcagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagtaaggattcagcctttttaattattcatttaaagaaatttactatagagtatcaaatgtacaactgatcacatgtaaccattgttttgtatgtagttctgtctagcttttttttttttttaacctttttaactgcatattagagcaggatgaaactttagaggttactcaatcttttaatttaaggagaaagtaaacanttactttgtgaacatgatagataaaaaaaaactggaccggg

SEQ ID NO: 3601 - DNA, 308 bp, Homo sapiens
ggaggcaggaccttgtcctattcattaatcttgcccctcaacagttattttcagaggggcaagaagtgtttcagggttcttggcccttgtttgaccagtcgtcctaaccctcrtgtcttgggtcattgttgttrtaatctggggttaccttttggaaggtcatggggtacccttttgcaaaagttatgggccctmtccttggaaactgcacacacaccatgcagcttacaattcagggagttcacaggtctacagaatcctgggaaactctccatgtccggttctaatccattgtagcttcagtggga

SEQ ID NO: 3602 - DNA, 1568 bp, Homo sapiens
  misc_feature (1550)..(1550): n equals a,t,g, or c
  misc_feature (1564)..(1564): n equals a,t,g, or c
ctcatcagccctatgaggtagggaggtaggtattattatcacccttgttagtttttttgttttgttttgttttccagatgagagaatcattgctcacagaagtgaagtaacttttccaaggtcatacaatcagtaagtggcaggcaaggactgaaatccaagttgttaccctccaaagtccctgctctgagaactggaggaattctttatcaaatctaaaatcctcttttagscctgtctgctttaatattccggtctttattgatccttctcttctctaaamcttcagctgtcagtataaaaatcaaggaatttagcmcttgttattgtgtgamcagcttcttgtctctcctgtactgtaagtgggtctagggatttttattctttaaatatccccctgtactcagtagatctttgggagamcaagctcataggcttctaataattctttctttgactgccagctgaattagacagaaggtaagtcctgctgccgtgtcgtgcctaaccccatctttatttcctgtgctgttagagaacagtcttttcttggctggaacaaatactacagcctgctcaactagctaatatgtattgagttcttartatgttccaaggactgctctaagtattttatatatattaactcactgaatcttaaataccctatgagctaagtcctatttttatccccattttacaaaagaggaaactgaatgtaccagtgcatcagtatttgactgagtaaatgaatgactgctttgctgatggatagtattattagcaacaaccctacaaatatgatgttatgtttgcatcatgcagtacagctttatgtaccttatgtcattgtcactcatgattagcaaataggcacgaacatccctattttatagaagaggaamccatggctctaagagggtgagtgattctcaacagtcacatgccatctgtatccttcagtaaacaaggtatttggtccattccaggatcgggggcaagagagatgggagggcctcggtgagaaacactcatattcacaaaaggtactagatagatagacagataaataaataaatagagataaaagctagtaatagcagagatttgatgggaattcagatctttgattcctagtccagtgctctttcttttatgtaaggtgatgggaagcaagtcttaggtccagatctggcagctgctttgatttaggatcttaagccagaagcagcagcgccctaaacaaaaagcatcattttaacttctctgcatttctcacattctcaacaatgaccatgccctactttcataattaaaaacaaacaaataaacagagggggcaaaatgcatccttctgagtgggctggggcttgtagagggattcttgggtttgctctgggatgtctttgggcccctgcacttgtgggcactctgatttatccccacaggccacctggcccaccttatgggctgaggagggcttgatgggcggaggsaagcagagctgaggagctggggaggagctggaaaggactgctagaaggttccantgaagctacaatgngtag

SEQ ID NO: 3603 - DNA, 865 bp, Homo sapiens
  misc_feature (13)..(13): n equals a,t,g, or c
  misc_feature (20)..(20): n equals a,t,g, or c
accgcagcctgcngggctcnagcattcctytsgcytcagcctcctgaktagctgggaccmcagytccactaattttgaagttttttkggtagacatgaagtctccctgtgttgcccgggctggtctcaaactcctgacctcaagcagtcctcctgtcttggcctctggaaatgctgggattacaggcgtgagccactgtgctggcctcttttttctttttctttttttttaaggtttttatttgttaaatgggaagtctgtgccatcaactgagcattgtattttctccttagtaagagcctgggtgggccactgggagagaactatacattaaatgtaagtagcctctgggtagagagcccctggctggtttcctttcctttctctccttttctctactttggtgtctggaggcatttcccagactccagtttcttaccaccctcacggattttgctattgtattatcacctcctttatcattcccaaaattgactttatggagactcattaaaagaaagaatcatcggccgggagcgtkgctcacgccacgaaggcgggcgaatcacctgaggtgcggagttcgtgaccagcctgaccaaaacagagaaaccccatctctactaaacaatacaaaattagctgggcgtggtggtgcacgcctgtaatcccagctactggggaggctgggacgggagaatcacttgaacccgggaggcagaggttgcagtgaccaaagatcgcactattgcactccagcctgggcaacaagagcaaaactctatctcaaaaaaaaaaaaaaaaaaaaaaaaaagggcggccgctctagaggatccctcgaggggcccaagcttaggcgtgcatg

SEQ ID NO: 3604 - DNA, 1687 bp, Homo sapiens
  misc_feature (1568)..(1568): n equals a,t,g, or c
  misc_feature (1652)..(1652): n equals a,t,g, or c
  misc_feature (1654)..(1654): n equals a,t,g, or c
  misc_feature (1660)..(1661): n equals a,t,g, or c
ccacgcgtccgggcagtggggtgagggcacacaagcagttcagggtcccagcaggaagtggggctgcagggccggggtgggtcctgggcctggccatcaggcagcctagcaggttgttctgggcatggagggggcctggtgtggctgagggcatgcccagggctccctggaggatcccgctctgtgccctgcccaccctgtgcctggggagccctctgccctcacagcccacccaccccattttctatgaccacagagctccgacctggaagatggctcacccaggaggtcccaggagctctcactcccccaggggacctggaggacacccagctctcagacaaaggctgccttgccggcggggggagcccgaaacagccctttgcagctctgcaccaggagcaggttttgcggaacccccatgtaaggcttccccggggtggggtcctcccagccgtgggcctcagggtgaccgatcacagggagagtggctccctgccctgggcaccccctgcggtggccccgacgacagctgaggagtgaccacaaggtctctgcccacagtgctcggggtgcggtgtctgggctgcgaagtggatccccctcctttcttgggcactgcagcagcttggggggctttttggacgtggatgtgcctggtcctggtttcccgagggcctttacagtggatgaggaggtgaacacagggagtcctgagagcaagcaccacctcgggctttggtgtagaaacaatggcccggaccccaggccggagccgtggcttggcctcctgggtgtgtcttggcatctgaaatgcaggctacccacaccggctcacctccaggggtacaggcaggtcccacagggagagcttggcgctgagctgaggctgtctgggctcctcgcctcccaaccagtctgcagttacaggggccagtggatgggcgggtgagaaggacgggttccctcaggggagccggccggagcccgagccttcccccttctccaggacgcaggcctgagcagcggggagccgcccgagaaggagcggcggcgcctcaaagagagttttgagaactaccgcaggaagcgcgccctcaggaagatgcagaaaggatggcggcagggtggaggaggaccgggagaacaccacgggcagcgacaacaccgacactgagggctcctagccgcagcagccgcaggccccgaccagggcacacccaccggcccggcctcctgccacccgggggtgccgacgccctggggcgcagacttccccgagccgtcgctgacttggcctggaacgaggaatctggtgccctgaaaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgcaaaaaaaaaaaaaaaaaaaaaaaaaaaaaaaaaanaaaaaaaaaaaaaaaaaaaaaaaaaaaaaaaaaaaaaaaaaaaaaaaaaaaaaaaaaaaaaaaaaaaaaaaaaaaaaaaaaaananaaaaannaaaaaaaaaaaaaaaaaaaaaaaaaa

SEQ ID NO: 3605 - DNA, 570 bp, Homo sapiens
  misc_feature (5)..(5): n equals a,t,g, or c
  misc_feature (16)..(16): n equals a,t,g, or c
  misc_feature (496)..(496): n equals a,t,g, or c
  misc_feature (523)..(523): n equals a,t,g, or c
  misc_feature (531)..(531): n equals a,t,g, or c
ttccngtgccactatngaatgtacgcctgcaggtaccggtccggaattcccgggtcgacccacgcgtccgggcagtggggtgagggcacacaagcagttcagggtcccagcaggaagtggggctgcagggccggggtgggtcctgggcctggccatcaggcagcctagcaggttgttctgggcatggagggggcctggtgtggctgagggcatgcccagggctccctggaggatcccgctctgtgccctgcccaccctgtgcctggggagccctctgccctcacagcccacccaccccatttwctatgaccacagagctccgacctggaagatggctcacccaggaggtcccaggagctctcactcccccaggacctggargacacccagctctcagacaaargctgccttgccggcggggggagcccgaaacagccctttgcagctctgcaccaggagcaggttttgcggaacccccatgtaaggcttccccggngtggggtcctccagccgtgggcctcanggtgaccnatcacagggagagtggctccctgtcctgggcaccccctg

SEQ ID NO: 3606 - DNA, 1752 bp, Homo sapiens
  misc_feature (1099)..(1099): n equals a,t,g, or c
aaggtacgcctgcaggtaccggtccggaattcccgggtcgacccacgcgtccgtccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggmtgtccacttggccgtgcatgggcactgggaagagcctgaagatgaggaaaagtttggaggagcagctgacttaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaaytcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttagacgaacatctgccccttcaggnaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaaygtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgcctgcgctttccctcatcctccttctcaaaaaggatcacgcgaaagggtggctgaggctcttgaaacaggacgtccgctcgggggcggccgc

SEQ ID NO: 3607 - DNA, 536 bp, Homo sapiens
  misc_feature (508)..(508): n equals a,t,g, or c
ggtcgacccacgcgtccgcccacgcgtccggcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtattgatcaaaaaaaaaaaaaaaaancccggggggggccccggaacccaatccc

SEQ ID NO: 3608 - DNA, 716 bp, Homo sapiens
  misc_feature (630)..(630): n equals a,t,g, or c
  misc_feature (710)..(710): n equals a,t,g, or c
gcctcagcggccgggcccacggccccgagcagccatgctgggcgcgcgggcctggttgggccgcgtccttctgctgccccgcgccggtgcaggcctcgccgcragccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcactatttncctcctgaaggatggcttgamccgagtsggttccgcacagtgttkctgagaatacgagaacartggaaacagaacaagancaccct

SEQ ID NO: 3609 - DNA, 2716 bp, Homo sapiens
ggccgggcccacggcmccgagcagccatgctgggcgcgcgggcctggttgggccgcgtccttctgctgccccgcgccggtgcaggcctcgccgcgagccgcaggtctgcctgcagtcccacttccaggctgaactccctgaggtctctgattccctaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagaggktccccaaccgcctgatccacgagaagtcaccatacctcctacaacatgcctacaatcctgtggactggtacccctggggasaggaagccttygacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagargatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaaaaaaaaaaaaaaaaaaaaaaaaaaaagggcggccgc

SEQ ID NO: 3610 - DNA, 427 bp, Homo sapiens
ccacgcgtccggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcaaaaaaaaaaaaaaaaaaaaaaaaaaaaaaaaaaaaaaaaaaaaaaaaaaa

SEQ ID NO: 3611 - DNA, 2409 bp, Homo sapiens
  misc_feature (694)..(694): n equals a,t,g, or c
  misc_feature (716)..(716): n equals a,t,g, or c
  misc_feature (755)..(755): n equals a,t,g, or c
  misc_feature (761)..(761): n equals a,t,g, or c
  misc_feature (791)..(791): n equals a,t,g, or c
  misc_feature (808)..(808): n equals a,t,g, or c
  misc_feature (880)..(880): n equals a,t,g, or c
ccacgcgtccggcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgnggaccggcggcgtctacctggnggccgggaagctctttgggctgcaggaggccatgaaggnggccgnggacatgatgtgttccagctgccaagaagncggggccaccatcgggngctgccacaaaggatgcctccacacctaccactacccgtgtgccagcgatgcaggttgcatattcatcgaanagaacttttctttgaaatgtcccaaacataagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgcgtccaggggccttcccgcccagcctttgccagatctctcgtgcggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaaaaaaaaaaaaaaaaagtcaataaagatacaacgattgttttggaaaaaaaaaaaaaaaa

SEQ ID NO: 3612 - DNA, 737 bp, Homo sapiens
  misc_feature (1)..(1): n equals a,t,g, or c
  misc_feature (21)..(21): n equals a,t,g, or c
  misc_feature (369)..(369): n equals a,t,g, or c
nagagggaagagagaaaaagntacaatgcttcgccgtycgsctktmcgkccsygtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaaaaaaaaaaaaaaaangtcaataaagatacaacgattgttttggaaaatctgcagcccgtggattccgaccagattcagctgggagccgggccaggctttaggttggggaatgggaatgaagggaggggctgggggggggggcatgaatggagtcagggagtcggcctttcacagaacaggaaacctcccccgcccctgtgccccctctccagtgtggcggcaggtcgggagggaggaggcttctttgctgtgagatgaccaggggccgggatgggggaggtgagacgtgccagacttcttgcagggagacccaagctgtagctcctgtcccacaacaggtcctggaagtcagtccatcctcccgtgccacccagggacctaat

SEQ ID NO: 3613 - DNA, 1471 bp, Homo sapiens
  misc_feature (798)..(798): n equals a,t,g, or c
tttctgaatgcaatgactgttttttactcttaaggaaaataaacatcttttagaaacagctcgatacacacaatcttcagtgtgaagcaatatactaataagaacactagtcgtcttaacatttacagtcttcatatatattatatatatgtatatgtatacatatatatacactatataacgaggccagatataatacacacgtttaccattttacagtcatatgtacaggaagttgctagggcggccctgggctgggggctgcgtcaggcctatcgaagcgtggacagagctgaggacacggacggacaggcggacggactggcagggactggcccgggccggtggtggctgcgtggacaagtggcgtcgcggtagccccttacccggcaaaggcccggttggggctctgttgcgggcgcacgacgcacggcggcgacacacgggagaagcgagcatgttcccaacatatatacattctatgtaacatatatatagaggggtacacaggttttgtacacgaaatctagcgctgtccctgctcccgtgcagagtaggcgcggcggtccctggtggtgcacaacggtcgcgcgtccgccggagccggaggtgcgttctggccgcttcttgggttttgcgctcccaggctgggctccaggggtggggtggaggactggaaaggggacaaacagaggccaaagggtgtcccagtcccgcccacactcggggatcccgcaacccctaactgagcatagcccargtctaccccggctttgcccgaaccgcacgagagatctngcaaargctgggcggraaggcccctgracgcgttccgcacggtttgttccaaaggctccggcctytccagtgccggcctagcccgctctcagaaaggcttcctttctccyccgcctagtccacggagctaggagccgccctccgcctcttccagtactgtttcgacccccacccccaagcccagggctcccagctgcacgccacgaccgactggggtggcggcagcacccacgtggaatgtgtgccacgtcgtcttgagattccagagggaaagtgtccccaggacaaagccgtctcccaccctcgccggaggctgagcgccccggggagtctggccgctccgcgggctccccctccgcaagcctggcccctggggtgggcaagaacgccctgtgccgtccggttccgggagcagkcggctccggaacgggttttcctcccaacccggggccgcaagtctgagccctaggcggccggatccacgatccgggacccggatcaaggatcggctctggaccagcgctgggagcagctcaaaggcccgggggctgcgcaggcggctcctctccttcggcggcgsgcgggcaggcgggctccggcggctcctmcgrccgttggggtggattactacggcagcctcttatgtttgggacatttcaaaggggaattctct

SEQ ID NO: 3614 - DNA, 1257 bp, Homo sapiens
  misc_feature (549)..(549): n equals a,t,g, or c
  misc_feature (589)..(589): n equals a,t,g, or c
gttttcagcaggattttcctttcagtgaaacataatttgacttgaaaggaacccagggaaaagtgtccaggtgtgagcatgagcgggtagaggtgtgcccttgtttgcttcaggctgtctgcttttcgcccctgactgttttttctgtttctggccatggaggaagagaaagatgacagcccacaggctgacttctgcctgggcaccgccctgcactcttggggactgtggttmacggaggaaggttmaccgtccaccatgctgacggggattgcagttggagccctcctggccctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccnggcctgcascccaaggacccccggccttccctgctggagnccgacttcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccrcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcagatcacgggggcggccgc

SEQ ID NO: 3615 - DNA, 959 bp, Homo sapiens
ccacgcgtccggtattttctaaaacaataaatttatagtgttaatattcatagggtcaatcaaaatgaagcttctcctttgggcctgcattgtatgtgttgcttttgcaaggaagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtccctccttcaaggtttttttcagcagctgcagcacccgctgccccacctattgcagctgagcctgctgcagctgcacctcttacagccacacctgtagcagctgagcctgctgcaaggggccctgttgcagctgagcctgstggcagaggccacctgttggagcttgagcctgctgcagaggcacctgttgcagctgagcctgctgcagaggcacctgttggagtggagccagctgcagaggaaccttcaccagctgagcctgctacagccaagcctgctgccccagaacctcacccttctccctctcttgaacaggcaaatcagtgaaattctctagaagagtaccatgggttcatttctatactgatgcagaaataagtgaaatctacaaaagttttctttcttttccaaagactatttcattctgttgtattcagagtattcatctcactacattgatttgtttgtggtagtttttccttggacttaatttatattgaaaaaacattgataattaaataaataaaatagataatttagaccaaaaaaaaaaaaaaaa

SEQ ID NO: 3616 - DNA, 2227 bp, Homo sapiens
  misc_feature (289)..(289): n equals a,t,g, or c
cggacgcgtgggtcgacccacgcgtccgggaaaaarggaaaaratgccgtgtaaaatctcgttctgtgtctgaattgccgtaggctcagatcttcatttgaggttctgtgtctgaattgccgtaggctcagatcttcatttgaggttatgttctataagttaacgttgatcttgtgtgagctttcggtagctggagtaacacaggcggcctcacagcgacctctccagcgccttccaaggcacatctgcagccagcgtaatcctcctgggagatgcctcctcaaggccntgctccagaccacgtggggarggcctgacarccaattcccaggctgtccccacccttgragagtgaccctaaacgctagacagatggggaatgggaaagaaaagaaagctgcagacctcaagttaaaattccctcaaaaacgtttttatttatctgctttttctgaaaggataaaggctttttgaaaattattttctaacaaataacatgaacacttctagaaaccctagaaaaacacaaagtattcaaaatagaaagaaaaattacccattactctttaagccagcattatccattgcggtgcttttggagttgggtgaggccgtagcctctgccaagtcaaggagcccggtggtggctgtggcattcctgcagggttgtttttttttctttgagatggagtctcactcttgtcaccccagctggaatgtggtggtgtaaacagctcactgcagccttgaccctgaggctcaagcgatccttctgccttggcctcctgagtagctgggatcccaggcgagagtcaccacaccctgtccatgttcctgcaggtcttgatatgcgaggacgctgtgtcttccctgccacattttcttcttctttcttgagacagacccttgctccatcacccaggccagagtgtggtsgtgcgaacacggctcactgcagcctcgaccctcaggctcaagcgatcctcacgcctcggacccccaaagtgctgggatcacaggcgagagtcaccatgctggcctgaatcttcagggtattttacggttgaagtgtcacttacttarccatscctgtttcaagagtgtaggtggtcaccctgtctctgycgctgacctggcctggaccctcggctgtgagagggaggggtgggctgggctggaggaacctraagccctcgtgatgtcacaagcccatctggctgggcatcccctgctgtgtcctgagctgcacatgccccaggtggcccccacagcagaggcgagccactgragggtgragggcttccacggacggtcttcaggggragaagaagggcccaggcccccaggagactcaggagaccagagcctggggtcaggggctyagcaggggctyarccagggctggatgtccggagccagccccgmagccctgkgktctttgttcttcgcactcccaccgtccgtgtgaacagctccagccccacctgcgcctccctgtgctgggctccatcagggagcccagaagacgtgtgtgcttctgaaattgggtccctacatgcctttgtcccagtgcaccttgctccttccatttactatcgagatttaaatgcctgttttctccccagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggytctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgtaaaaaaaaaaaaaaaaaaaaaaaaaaaaaaaaaaaaaaaaaaaa

SEQ ID NO: 3617 - DNA, 2214 bp, Homo sapiens
  misc_feature (289)..(289): n equals a,t,g, or c
cggacgcgtgggtcgacccacgcgtccgggaaaaarggaaaaratgccgtgtaaaatctcgttctgtgtctgaattgccgtaggctcagatcttcatttgaggttctgtgtctgaattgccgtaggctcagatcttcatttgaggttatgttctataagttaacgttgatcttgtgtgagctttcggtagctggagtaacacaggcggcctcacagcgacctctccagcgccttccaaggcacatctgcagccagcgtamtcctcctgggagatgcctcctcaaggccntgctccagaccacgtgggrarggcctgacaagccaattcccaggctgtccccacccttgragagtgaccctaaacgctagacagatggggaatgggaaagaaaagaaagctgcagacctcaagttaaaattccctcaaaaacgtttttatttatctgctttttctgaaaggataaaggctttttgaaaattattttctaacaaataacatgaacacttctagaaaccctagaaaaacacaaagtattcaaaatagaaagaaaaattacccattactctttaagccagcattatccattgcggtgcttttggagttgggtgaggccgtagcctctgccaagtcaaggagcccggtggtggctgtggcattcctgcagggttgtttttttttctttgagatggagtctcactcttgtcaccccagctggaatgtggtggtgtaaacagctcactgcagccttgaccctgaggctcaagcgatccttctgccttggcctcctgagtagctgggatcccaggcgagagtcaccacaccctgtccatgttcctgcaggtcttgatatgcgaggacgctgtgtcttccctgccacattttcttcttctttcttgagacagacccttgctccatcacccaggccagagtgtggtsgtgcgaacacggctcactgcagcctcgaccctcaggctcaagcgatcctcacgcctcggacccccaaagtgctgggatcacaggcgagagtcaccatgctggcctgaatcttcagggtatttrcggttgargtgycacttacttarccatscctgtttcaagagtgtaggtggtcaccctgtctctgccgctgacctggcctggaccctcggctgtgagagggaggggtgggctgggctggaggaacctraagccctcgtgatgtcacaagcccatctggctgggcatcccctgctgtgtcctgagctgcacatgccccaggtggcccccacagcagaggcgagccactgragggtgragggcttccacggacggtcttcaggggragaagaagggcccaggcccccaggagactcaggagaccagagcctggggtcaggggctmagcaggggctyarccagggctggatgtccggagccagccccgmagccctgkgktctttgttcttcgcactcccaccgtccgtgtgaacagctccagccccacctgcgcctccctgtgctgggctccatcagggagcccagaagacgtgtgtgcttctgaaattgggtccctacatgcctttgtcccagtgcaccttgctccttccatttactatcgagatttaaatgcctgttttctccccagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgtaaaaaaaaaaaaaaaaaaaaaaaaaaaaaag

SEQ ID NO: 3618 - DNA, 1005 bp, Homo sapiens
  misc_feature (1004)..(1004): n equals a,t,g, or c
atgggaaatgctcttttgaaggtacgcccgcaggtcccggtccggaattcccgggtcgacccacgcgtccggccagaagcagccatgaagtgagcctgcaggcaggccagcctgtgaccatcctggaggcccaggacaagaaggggaaccctgagtggagcctggtggaagtgaatggacagaggggttatgtgccttctggcttcttggccagggctcggagcccagttctgtggggctggagtctgccctcttagggtaccctctttggagcctacattgccaaatgatgggggaggcttagaggctctgaccctggggggaaaagaagcaaaggaaaggtggaggtggaagggaagaccaggccagggtgggtgaagcacactcaggaggcagccagaagacatgggcgggcctcgcagagtgcttggtgtggtgggggcacaggaggctccagccaggactgctcattatgtctgcataaagaactcattccgacctggggtcacaatgcacttggacagcaggtcacagctgattggccaggactctcgataggttatggccagtcttagctgtgcctgcatccgggcctgcctgtgggcgtgggtcacacgggataatgttacctgcgtgctgtgtggttgcaggaagcgggttctggaggagtccagaactgcctggtcagacagttcacttcctacacatggtatcaggagacatcataaccaatgagtcagcttttatttctctatgctggaagctgagtttatcttgggcagtgacccactgggagccctctcaagtggggaagccatggatttatcggtgtagcagagaggttcccaagactcttgactggtcctgggagtgggtgtgaccaagtcatagttctggaatgtgtgtaggcaaattcagaggctgttccagggaagaggggattttgatactgtgttaggtggggtgtgtgaggctgytggcagcaggtgaacagctactgctgng

SEQ ID NO: 3619 - DNA, 2988 bp, Homo sapiens
cccacgcgtccggccagaagcagccatgaagtgagcctgcaggcaggccagcctgtgaccatcctggaggcccaggacaagaaggggaaccctgagtggagcctggtggaagtgaatggacagaggggttatgtgccttctggcttcttggccagggctcggagcccagttctgtggggctggagtctgccctcttagggtaccctctttggagcctacattgccaaatgatgggggaggcttagaggctctgaccctggggggaaaagaagcaaaggaaaggtggaggtggaagggaagaccaggccagggtgggtgaagcacactcaggaggcagccagaagacatgggcgggcctcgcagagtgcttggtgtggtgggggcacaggaggctccagccaggactgctcattatgtctgcataaagaactcattccgacctggggtcacaatgcacttggacagcaggtcacagctgattggccaggactctcgataggttatggccagtcttagctgtgcctgcatccgggcctgcctgtgggcgtgggtcacacgggataatgttacctgcgtgctgtgtggttgcaggaagcgggttctggaggagtccagaactgcctggtcagacagttcacttcctacacatggtatcaggagacatcataaccaatgagtcagcttttatttctctatgctggaagctgagtttatcttgggcagtgacccactgggagccctctcaagtggggaagccatggatttatcggtgtagcagagaggttcccaagactcttgactggtcctgggagtgggtgtgaccaagtcatagttctggaatgtgtgtaggcaaattcagaggctgttccagggaagaggggattttgatactgtgttaggtggggtgtgtgaggctgttggcagcaggtgaacagctactgctgtgttctcaggactagggaacaaaggggtatgcaaatcatagaggaaactctgggaaggcggtgataaggcctggtgggtggggaggttagggaatggcttgctttcctgtttctggttagaaggggagccagggggaacccccagtggtttcaggtggcccctgaggtcctggaggcagccgtggatgtgatgcaattggctgtgggaccttagatgtaggacacaacttcagtgttcccatccagaaagacctcactcacagggttgtgctgagaatgacatggggctaagcatgcagagctccctgtaaactgtgaagtgtgatacaaatgtaaatgacagcagtgatctcggggtggcccccggcatgctgccctcccccacgcccatgcctgtggcagcaaaccttgttcatcagtatagctttctttcctgtaacccaggatctaccttggggggcttctcaatactgcattctatgtagccagcctctttaacttggtaagtgagccaccccattctagaacctggaaattggagcccctcaaaaacagttcctgttcaaggaggactgacctgctggggcaatgttgggtgcagtgcagtccctgcttggggtggtcatgtctaggctgttgctctgggcaaagataagttgcaagattcacagaaatgggaaaatgtgaccaagtgtgatcttaacaactgacaaagtttgtaaccaacccaagttagaatgtgtgtcaaacaggaggtagtttagatatgcttccaagaacatgtctgtgttataaccatagtgcctaagcagtgagctctggtttttgaagggcttttaagaaatatatacatgtctgtgtcagtctataacttgcctcctctgggcctgttaaagcatgaagactgcatgacacaagagaaatgcaagccctacggttcctttctcagcagcgaattcacttgagaggatgctcttgactcattctctctgctctttcctgctcagatttctgataaaaatagagagcataggggaacagataatgaaataggaaacccactcgtgggttccacagatacctaccgaaggcctactgtgtgctagaattgtagctcaggagttctcagtgtagctgctcactgaagttaccatggcaggtttcaactggcagaatccaggctccgtcccacccagagattctgatgaaattggtttagggtgtggctcgggcctcaggaattcagaaagcttcccaggtgcttccaatgtgcagccagggttagggacctctaccctagacacaaagtattggacagatagacctggtgccagagatggccaagagctgtaagctaggacgtgccccacctgagctctgcactagctagttcaaacaggcgctttaaaggcagtgtgaaaggggacagcctgttctgccaggtctcagaatgtatatttattaagtgccattaaaagggacctgaacaaaattggatgtcttgtaggcataagggaggaaaataaaatatacttggaaccaagtctatgtcatgaagggaaaataaaaatgtattcagtagcacgtgggttatggtttctcatagaccaggggataagattaaaagtcactgaagagtgggaaaatgcatgttgagaagatgagaatggcctgtattttctccaggggaatctgtgtaatgtgccttttccctctccaaatgcctagaaccatggcactgtgtcttatttatttaaccgttgggctgtctcatactaaacttgcaaagatatttgcctatgaactgaacaagacttccaggagttgaagtctggttcacaagggtaccccttgcctcctgtgatggagtgagaactcttaaacccctcaggccccaactcagttgtggagatgaggacaagattacaatatcaaaagaaagatgaatgaattcttggttaatatgacgaaccccagctcaatgagtaactgatgtgaactgctgggaataaaggacttcaaagatggaaaaaaaaaaaaaaaa

SEQ ID NO: 3620 - DNA, 2052 bp, Homo sapiens
tttttttttttccatctttgaagtcctttattcccagcagttcacatcagttactcattgagctggggttcgtcatattaaccaagaattcattcatctttcttttgatattgtaatcttgtcctcatctccacaactgagttggggcctgaggggtttaagagttctcactccatcacaggaggcaaggggtacccttgtgaaccagacttcaactcctggaagtcttgttcagttcataggcaaatatctttgcaagtttagtatgagacagcccaacggttaaataaataagacacagtgccatggttctaggcatttggagagggaaaaggcacattacacagattcccctggagaaaatacaggccattctcatcttctcaacatgcattttcccactcttcagtgacttttaatcttatcccctggtctatgagaaaccataacccacgtgctactgaatacatttttattttcccttcatgacatagacttggttccaagtatattttattttcctcccttatgcctacaagacatccaattttgttcaggtcccttttaatggcacttaataaatatacattctgagacctggcagaacaggctgtcccctttcacactgcctttaaagcgcctgtttgaactagctagtgcagagctcaggtggggcacgtcctagcttacagctcwtggccatctctggcaccaggtctatctgtccaatactttgtgtctagggtagaggtccctaaccctggctgcacattggaagcacctgggaagctttctgaattcctgaggcccgagccacaccctaaaccaatttcatcagaatctctgggtgggacggagcctggattctgccagttgaaacctgccatggtaacttcagtgagcagctacactgagaactcctgagctacaattctagcacacagtaggccttcggtaggtatctgtggaacccacgagtgggtttcctatttcattatctgttcccctatgctctctattttkatcagaaatctgagcargaaagagcagagagaatgagtcaagagcatcctctcaagtgaattcgctgctgagaaaggaaccgtagggcttgcatttctcttgtgtcatgcagtcttcatgctttaacaggcccagaggaggcaagttatagactgacacagacatgtatatatttcttaaaagcccttcaaaaaccagagctcactgcttaggcactatggttataacacagacatgttcttggaagcatatctaaactacctcctgtttgacacacattctaacttgggttggttacaaactttgtcagttgttaagatcacacttggtcacattttcccatttctgtgaatcttgcaacttatctttgcccagagcaacagcctagacatgaccaccccaagcagggactgcactgcacccaacattgccccagcaggtcagtcctccttgaacaggaactgtttttgaggggctccaatttccaggttctagaatggggtggctcacttaccaagttaaagaggctggctacatagaatgcagtattgagaagccccccaaggtagatcctgggttacaggaaagaaagctatactgatgaacaaggtttgctgccacaggcatgggcgtgggggagggcagcatgccgggggccaccccgagatcactgctgtcatttacatttgtatcacacttcacagtttacagggagctctgcatgcttagccccatgtcattctcagcacaaccctgtgagtgaggtctttctggatgggaacactgaagttgtgtcctacatctaaggtcccacagccaattgcatcacatccacggctgcctccaggacctcaggggccacctgaaaccactgggggttccccctggctccccttctaaccagaaacaggaaagcaagccattccctaacctccccacccaccaggccttatcaccgccttcccagagtttcctctatgatttgcatacccctttgttccctagtcctgagaacacagcagagctttc

SEQ ID NO: 3621 - DNA, 628 bp, Homo sapiens
  misc_feature (137)..(137): n equals a,t,g, or c
  misc_feature (450)..(450): n equals a,t,g, or c
  misc_feature (465)..(465): n equals a,t,g, or c
  misc_feature (488)..(488): n equals a,t,g, or c
  misc_feature (585)..(585): n equals a,t,g, or c
  misc_feature (619)..(619): n equals a,t,g, or c
gcacctcaggccctccaagcgcaggatgcaggccgtggccaacgtgtccattggggccatgttctgcatgtatgggctcacagcaacctttggatacctcaccttctacagtragtggggctggggctagggctggngggagggggaaggcctggggcaggagcctctgagctctttccttctgtgaccacggacctgtcagtttccaaacagaargtgtgcctcacttgtgtggattttgtcactgtgcatgtatgtatgggtttctggggcattggtcctggtgctctctccacatcctgcatcccgtaccctctgtctcatggsccargcartgtgaaggcggagatgctgcacatgtacagccagaaggacccgctcatcctctgtgtgcgcctggccgtgctgctcgcggtgaccctcactgtgccagtcgtgctgttccctatncgccgggccctgcancagctgcttttcccaggcaaggncttcagctggccacgacatgtggccataagctctgatctgcttgtttggtcaatgtccttgtcatctgtgtgccaacatccgggatatctttggganttaatcgggtcaactcaagccccagctcatcttnatctcccag

SEQ ID NO: 3622 - DNA, 923 bp, Homo sapiens
  misc_feature (9)..(9): n equals a,t,g, or c
gggaacggnaaactcgtttgggttkggccawgctgcmcatgtacagccagaaggacccgctcatcctctgtgtgcgcctgkycgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccaaaaaaaaaaaaaaaaaaaaaaaaaaaaaaaaaaaaaaaaaaaaaagggcggcc

SEQ ID NO: 3623 - DNA, 1159 bp, Homo sapiens
ggaattttgttgttctctgtctctttgatttcctggaagacgacaccatgacaatttcaaagaaaatagaacaaaatgaaggaaaaagaggctctgtcttagcacattcctgtgaccagcctgctgtctgtggtgtgccctcctggcccggccttggcacatgttcgtttttgtggttgttgcctggacaggcaactctgcagggctgcttctctacgcatccctttgcctgcctgcctgtgccaggggttgtcaagggcttttgggtcagagtgggcacccctttctccaaggctccctgcaacagctggcctgtccctggtggggctgacagcttccttctcaccctgccaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccgggaaaaaaaaaaaaaaaaaaaaaaaaaaaaaaaaaaaaaaaaaaaaaaa

SEQ ID NO: 3624 - DNA, 912 bp, Homo sapiens
  misc_feature (275)..(275): n equals a,t,g, or c
ccgggtcgacccacgcgtccgacagcagagatctgtggagtaggattgtgggctggcagtgggtttatcccacagacctaagacagstacttaatttgtatagacccttcccagcctgggcctctgggttttccttctgggtggagatcatcttctgtaggaaatggaactgcttcaagccaagaagcttttacttttactaggtctttttgtgtcctgctgktcaaatattaggaagactgaaccctgtttcggtcttgacagtattacgtttngtgatcccaaaaaaaagtgtttgagtaacctcaagtcatgctgaaagtgaaatacagcttaaagtgggattctgctggacctgactcaacttttcacctcaccgcttggctccgtgcaggcagtatttgagtatgtggttccccctcaagtctgtaggagttgtattgtcaataaagtccaaggccagagtgcttgctttctagtaagtagagagaatttttgaaattcaacgacaaacatttattaagcccttattgtgtacagggctcaaagctaagtgctttgggtgattcagggtgattagggataggattccatcttcaagaagcctcccatctaggaagaaaggtcgataagcatagttttggacacatgggagagcatggctttctctgggcccagtaattactttggtatccagatcattagagaacggaatgccttctattgaactatgtaacagtcacaggtttagatcttctcaagttattattgcctttaatcttcatatgatycctatcctgcagttaggaaatggaamccctaggatatagtgactgtgagctcagaaaattaggttgggagataagccagtagattgaggtggtagattcttcaagatcttgaaggggggaa

SEQ ID NO: 3625 - DNA, 321 bp, Homo sapiens
  misc_feature (3)..(3): n equals a,t,g, or c
  misc_feature (298)..(298): n equals a,t,g, or c
ccnaaaaaaaaaaaagaaagaaaactcattctatttttctctttggagcagaggttgcaaaactgtgatgcctaacaaaaacgttgtgtataaaagctccaaaaccaagcattagcctaaattggctataactgcaacttaaatcaaaaactatatccaactagatcttcgttgtggctatgcaactttttgctttgtggcctgaaggtttttactgaggtaacaacctcttatctcttgtccttccctcaaccacaaaagcaaaacccgggaattccggaccggtacctgcaggctnccttctatagtgtcacctaaata

SEQ ID NO: 3626 - DNA, 1145 bp, Homo sapiens
ttttttttttttttttttttttgactgaactaagtggcttttttattagagaaagccagaattacaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctcaaaaaaaaaaaaaaaaaaaaaa

SEQ ID NO: 3627 - DNA, 2342 bp, Homo sapiens
  misc_feature (66)..(66): n equals a,t,g, or c
  misc_feature (2332)..(2332): n equals a,t,g, or c
tccgggggctgctcctgcatcatccaacccttccaaacccctacacgatggctgtggctgcacgantcacggcagctaccacggtaacccacatcacagcctttgaccctgacagcacggggcagcaggtgtggcaggatctacttcaggatggacagctggactctcccactggtgatggggggtctgactgggagatggtgggaagagaggttgtccctgtcttgggaccaggggtgggaggcctggtaataagtaggccttgtttccatgttagggatccctatccctggggctgaaggggctcctgtcctgaattctcttgtgtttctctcaggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggcggtatacaaggttctttggccaggatggagatgcagcacctgccctcagccactatgcactgtgccgatacgcagagtgggaagagaggatctcagcttggcagagcccggtattggatgacagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggccaggagtaccgcatgtacaacacatatgatgtccacttttatgcttcctttgccctcatcatgctctggcccaaacttgagctcagcctacagtatgacatggctctggccactctcagggaggacctgacacggcgacggtacctgatgagtggggtgatggcacctgtgaaaaggaggaacgtcatcccccatgatattggggacccagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagctgtgatggaatctgaaatgaagtttgacaaggaccatgatggactcattgaaaatggaggctatgcagaccagacctatgatggatgggtgaccacaggccccagtgcttactgtggagggctgtggctggcagctgtggctgtgatggtccagatggctgctctgtgtggggcacaggacatccaggataagttttcttctatcctcagccggggccaagaagcctatgagagactgctgtggaatggccgctattacaactatgacagcagctctcggcctcagtctcgtagtgttatgtctgaccagtgtgctggacagtggttcctgaaggcctgtggctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagccaaaaaaaaaaaaaaaaaaaaactcgagggggggcccggnacccaattcg

SEQ ID NO: 3628 - DNA, 717 bp, Homo sapiens
ggcacgagctagctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaaaaaaaaaaaaaaaaaaaaaaa

SEQ ID NO: 3629 - DNA, 713 bp, Homo sapiens
  misc_feature (27)..(27): n equals a,t,g, or c
ccgcgggaacgctgtcctggctgccgncacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccaccctcctgggcctcattgggtatcacctatacagaaaggccaatagacccaaagtctccaaaaagaagctcaaggaagagaaacgaaacaagagcaaaaagaaataataaataataaattttaaaaaacttaaaaaaa

SEQ ID NO: 3630 - DNA, 1165 bp, Homo sapiens
ggcacgagccggtatgtggccccgtctggctagtcccgcctagcgcgcccatttcgagcccaagtttccagctcgggtttccaggctcagaattttccaggagtaggttcttgggcagtggctgtgggagctggaatggcgcagctggaaggttactatttctcggccgccttgagctgtacctttttagtatcctgcctcctcttctccgccttcagccgggcgttgcgagagccctacatggacgagatcttccacctgcctcaggcgcagcgctactgtgagggccatttctccctttcccagtgggatcccatgattactacattacctggcttgtacctggtgtcaattggagtgatcaaacctgccatttggatctttggatggtctgaacatgttgtctgctccattgggatgctcagatttgttaatcttctcttcagtgttggcaacttctatttactatatttgcttttctgcaaggtacaacccagaaacaaggctgcctcaagtatccagagagtcttgtcaacattaacactagcagtatttccaacactttatttttttaacttcctttattatacagaagcaggatctatgttttttactctttttgcgtatttgatgtgtctttatggaaatcataaaacttcagccttccttggattttgtggcttcatgtttcggcaaacaaatatcatctgggctgtcttctgtgcaggaaatgtcattgcacaaaagttaacggaggcttggaaaactgagctacaaaagaaggaagacagacttccacctattaaaggaccatttgcagaattcagaaaaattcttcagtttcttttggcttattccatgtcctttaaaaacttgagtatgcttttgcttctgacttggccctacatccttctgggatttctgttttgtgcttttgtagtagttaatggtggaattgttattggcgatcggagtagtcatgaagcctgtcttcattttcctcaactattctactttttttcatttactctctttttttcctttcctcatctcctgtctcaacaaataaataaataaacataaatgcatgcattcatacatacaattgataaatctaatcttggccaaaaaaaacccaaaacaaaataaaaaaaaaaaaaaaaaa

SEQ ID NO: 3631 - DNA, 1160 bp, Homo sapiens
  misc_feature (345)..(345): n equals a,t,g, or c
gccggtatgtggcccygtctggctagtccygyctagcgcgcccatttcgagcccaagtttccagctcgggtttccrggctcagaattttccaggagtrggttcttgggcagtggctgtgggagcwggaatggcgcagctrgarggttactrtttctcggccgccttgagctgtacctttttagtrtcctgcctcctcttctccgccttcagccgggcgytgcgagagccctacatggacgagatcttccacctgcctcaggcgcagcgctactgtgagggccatttctccctttcccagtgggatcccatgattactacattacctggcttgtacctggtgtcanttggagtgrtcaaacctgccatttggatctttggatggtctgaacatgttgtctgctccattgggatgctcagatttgttaatcttctcttcagtgttggcaacttctatttactatatttgcttttctgcaagtacaacccagaaacaaggctgcctcaagtatccagagagtcttgtcaacattaacactagcagtatttccaacactttatttttttaactycctttattatacagaagcaggatctatgttttttacyctttttgcgtatttgatgtgtctttatggaaatcataaaacttcagccttccttggattttgtggcttcatgtttcggcaaacaaatatcatctgggctgtcttctgtgcaggaaatgtcattgcacaaaagttaacggaggcttggaaaactgagctacaaaagaaggaagacagacttccacctattaaaggaccatttgcagaattcagaaaaattcttcagtttcttttggcttattccatgtcctttaaaaacttgagtatgcttttgcttctgacttggccctacatccttctgggatttctgttttgtgcttttgtagtagttaatggtggaattgttattggcgatcggagtagtcatgaagcctgtcttcattttcctcaactattctactttttttcatttactctctttttttcctttcctcatctcctgtctcaacaaataaataaataaacataaatgcatgcattcatacatacaattgataaatctaatcttggccaaaaaaaacccaaaacaaaataaaaaaaaaaaaaaaaaactc

SEQ ID NO: 3632 - DNA, 680 bp, Homo sapiens
  misc_feature (7)..(7): n equals a,t,g, or c
  misc_feature (9)..(9): n equals a,t,g, or c
  misc_feature (15)..(16): n equals a,t,g, or c
  misc_feature (22)..(22): n equals a,t,g, or c
cactcantngaacannagctcnagctccaccgcggtggcggccgctctagaactagtggatcccccgggctgcaggaattcggcacgagatatttcgctggaccctagaaaagccaccacgacctgtgggccatgatgctaccccaatggctgctgctgctgttccttctcttcttctttctcttcctcctcaccaggggctcactttctccaacaaaatacaaccttttggagctcaaggagtcttgcatccggaaccaggactgcgagactggctgctgccaacgtgctccagacaattgcgagtcgcactgcgcggagaaggggtccgagggcagtctgtgtcaaacgcaggtgttctttggccagtatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgsctcctcctyctycacctgctctcctccctacccagagctctgtgktcaccctgttccccagagcctccaccatgagtggagggaagtggggagtgattgaaataaagagctttttcaatgaaaaaaaaaaaaaaaaaaaaaaaaactcgagggggggcccgg

SEQ ID NO: 3633 - DNA, 1188 bp, Homo sapiens
gctcgaactctccactgtccccatttcctgcaacagcatctcagagggcttgaggtggctatcaggccttccatcacagcataaagctccttcagggagagaagagcgaaggcacccagrctggggaacagcagctcctactatacctaccctgcccactctggtccaaccgtgggcttggcctgactttagactggaaccccttagtgctcctgttcctggtgtggagcagatccacctaccccaggggaaatgccaactactttgccttcagacctgatgctcctgtggttgggcctgccaagcctgccctccccagtggaagaagagggccgtcttgtgaaaggcctcaggctgacccttgcagcaccagcctctgaggtactgccagactgggaagaccctcccagccacccaacagcgtgggcccagcccaggacacatcagcccgacactccaaattctatcaagagtggcatttattctccttgtggaggtgcggtgctccggggagctggtgctattgtgcttaggaaggaggtctgtccgtccgtccgtctrtmcggccggcctggccccaaatgggggcggaagaggggcacggcccgagtaaaaatcccggcctattccgggtgggaatatgtacaaggcggcggggcacaggcgggggtgggggcgggcgggccggcggccgcagcccccacccgagggcccccgcacctcgggccctacttgtagaatcagtacaaaataggtgctacctaaacgttccttctacctgaattcgctaagtcggttattgtgctgcttagttatgggggcgggagggggcccatggctttccacggcggcggggtgtagggggaagcaggagaccctgacgggcccacagccctccagctttctccttaggtaggtagacaggagtatggggtggggtgaggtgggggcgcctgtgtgtgcgtgtgcatgcggcacaggtgggcaggccccagcttgggagctgtgcaggcaccacacctggttgtgtagggtgtttggatgtgggcactgctgtgcagagcggtgggtcatccttgtgggggcagccacgcttgctgctgggggtgaggctggccacaccataggctacagctggcaccttcttctccagccatgstyttgcccctsgtggacwtggcagatgtg

SEQ ID NO: 3634 - DNA, 1342 bp, Homo sapiens
ggcccgcccaggaggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccrtgcatggattgcttcattaccttttccatacgagaaaccacaccttcattgtcctgcacctggtcttgcaagggatggtttatactgagtacacctggggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttcca

SEQ ID NO: 3635 - DNA, 1955 bp, Homo sapiens
ggcacgagtgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaaggaaactcctggaactgttctagaagtcctcatttgcttctttacactctggtccgtcgtgggactgactggatttcatactttcctcgtggctctcaaccagacaaccaatgaaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagttttcgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccactagttgtatttattagtgtagcttctcctttgtctcccatccactctgacaccttaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaaaaaa

SEQ ID NO: 3636 - DNA, 1338 bp, Homo sapiens
  misc_feature (133)..(133): n equals a,t,g, or c
  misc_feature (867)..(867): n equals a,t,g, or c
  misc_feature (1338)..(1338): n equals a,t,g, or c
cttccggttctccgggcagctgccactgctgtagcttctgccacctgccacgaccgggcctctccctggcgtttggtcacctctgcttcattctccaccgcgcctatggtccctcttggagccagcgtggcgngcctggcggctcccgggtggtgagagagcggtccgggaacgatgaaggcctcgcagtgctgctgctgtctcagccacctcttggcttccgtcctcctcctgctgttgctgcctgaactaagcgggyccctggmagtcctgctgcaggcagccgaggccgcgccaggtyttgggcctcctgaccctagaccaggacattaccgccgctgccaccgggccctwacccctgcccagcagccgggccgtggtctggctgaagctgcgggggccgcggggctccgagggaggcaatggcagcaaccctgtggccgggcttgagacggacgatcacggagggaaggccggggaargctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatatttnaacaacctttaatttgctgttgcaataaataccgtatccttttattatatctttatatgtatagaagtactctgttaatgggctcagagatgttggggataaagtatactgtaataatttatctgtttgaaaattactataaaacggtgttttctgrtcggtttttgtttcctgcttaccatatgattgtaaattgttttatgtattaatcagttaatgctaattatttttgctgatgtcatatgttaaagagctataaattccaacaaccaactggtgtgtaaaaataatttaaaatytcctttactgaaaggtatttcccatttttgtggggaaaagaagccaaatttattactttgtgttggggtttttaaaatattaagaaatgtctaagttattgtttgcaaaacaataaatatgattttaaattctcttaaaaaaaaaaaaaaaaaccccgggggggggcccggn

SEQ ID NO: 3637 - DNA, 802 bp, Homo sapiens
  misc_feature (337)..(337): n equals a,t,g, or c
  misc_feature (359)..(359): n equals a,t,g, or c
ggtgggtgaccagagagtcctgtctatcctaggaggagaacattcagcccaaatcccagccccatcatgcacagatcagagccatttctgaaaatgtcgctgctgattctgcttttcctgggattggcagaagcctgtactcctcgtgaagtcaacttgctgaaagggatcataggtctcatgagcagactgtcaccggatgagatcctaggcttgctgagcctccaagtactgcatgaagaaacaagtggctgcaaggaggaagttaaacccttctcaggcaccaccccatccaggaaaccactccccaagagggaagaacacgtggaayttcctngaaatgcgsctacatggtgrtngacctacctcttcgtatcctacaacaaaggggactggttcactttttcctcccaagtgttactgccaytactgtaacttggaactggacatcagggatgatccctgctgttctttctagtgagcctgctccatctcagcttagccttcacaaggcctccatctcccaggcattctaacctctgaagaaagctctctgtcccctggactgcctgtgtggagggtaatgaactgggtcctttaaggaatggcacctgggtgcccagaggcatggccagaaggtgtctgtgggggccatgccttagggggatgcacccagggcggctgagagagcaactgcaggagtttcccctaaaatctctcctccagatcgttctcgaactttccccactacttccataataaaatgtatacttgttgaaaaaaaaaaaaaaaaaaactcgag

SEQ ID NO: 3638 - DNA, 1052 bp, Homo sapiens
tcgacccacgcgtccgcccacgcgtccgcccacgcgtccgggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcagcacctcctgcccccttccggctgctttggcccatccttgggggcgctctgagcctgaccttcgtgctggggctgctttctggctttttggtctggagacgatgccgcagagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggagggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggtggggggggggaaaaaaaaataaaaaaaaaaatttttaatttttaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3639 - DNA, 1037 bp, Homo sapiens
  misc_feature (936)..(936): n equals a,t,g, or c
  misc_feature (946)..(946): n equals a,t,g, or c
  misc_feature (951)..(951): n equals a,t,g, or c
ccggtccggaattcccgggtcgacccacgcgtccgggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaagggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcgggggggggatatttattttggggagagtttggaggggagggggattttttttttaaangattttttanttttnaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3640 - DNA, 1501 bp, Homo sapiens
tggcaacaaaagctggagctccaccgcggtggcggccgctctagaactagtggatcccccgggctgcaggaattcggcacgagcaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggcccsgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaagatgcagcatcaaaaaaaaaaaaaaaaaaaaaaaaaaaaaaaaaaa

SEQ ID NO: 3641 - DNA, 1251 bp, Homo sapiens
gcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagasagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgagaaaaaaaaaaaaaaaaaaaagtcgagc

SEQ ID NO: 3642 - DNA, 517 bp, Homo sapiens
cttcctggggacccaggcttttgctgtgccccttctgctgatctcsaggagccagacgtttggatataatggaagagcgtgtcaggagtggcttccgttsctgatctccagcatcctgatggcgtacactgtggctctggctaactcctacggacgcctcatctctgagctcaaacgtcagagasagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgaaaaaaaaaaaaaaaaaaaaaaaaaaaaaaaaaaaaaaaaaaaaaaaaaaaaaaaactcga

SEQ ID NO: 3643 - DNA, 559 bp, Homo sapiens
ggtcgacccacgcgtccggcccatatcacttaaaaagttcaaagccaaacaatgtttaacctctccttttttacattgtatggactttgtatgctgaagcttcattcagcctcctcctggttcacattgttattgttaatatcattatttttgtctgtcgtttattgtcagtctacaaattagatattattattgtttttgttttatacaggcaacatttatctggatttgcatagatgtttaccattttctttactcagtgttttatcaaatacatcctttaggaattcctttaatttggtctcttgttggcrtatgttcagttttcatttgtctattaaatgtttatcacttttttcgtgataggttgttctgctgggttcacaattttaggttgccagttctgtttttttgtttgtttgtttgtttgacacttggaagatattattctagtgtcttcaatattctgtctttggtctttggtcattctaattaccttttctttgtatatgatctgtcccttctccatggcttcttttaaaatcttctctttatcttt

SEQ ID NO: 3644 - DNA, 678 bp, Homo sapiens
  misc_feature (11)..(11): n equals a,t,g, or c
  misc_feature (171)..(172): n equals a,t,g, or c
gtatttctttnattatttatttcttgtctctgctacattttacattgagtaaaagtgggatgtgacagtgggaaatcattagtgacttagaaattccagttggtcattgggccaattttgatgctaccttctctcttttatttctcactttaaaataaaatttgcaaaagnnaaaaattaaatatagtatgagtccagttactggcctaaggagctaaaagcattctgggtttgtatgaagacagctgagttataacaaatgagagtactgttgtgtgactgcattaattattccctttttaaatgtacaagagcaaggcattctacctgactgtgttattgagctctgcagcatacatgtgacagagctaaaacaaacaagcaaacaaaagaaaccacagctttaggatactctgttcatgaatatagcctgaaaatgataatcaagaagtaaacttttaccagtattaaggaacattaagctgcctatctctcagtgaatttcagaatgatattttaaaagttagtttaggctgggcactgtagctcatgcctataatcccagcactttgagaggcagaggccaaggcaggaggatcacttgagccccggattttgagaccagcctgggcaacatagcaagacactgtctctaaaaaaaaaaaaaaaagggcggcc

SEQ ID NO: 3645 - DNA, 2674 bp, Homo sapiens
  misc_feature (2607)..(2607): n equals a,t,g, or c
  misc_feature (2611)..(2611): n equals a,t,g, or c
  misc_feature (2621)..(2621): n equals a,t,g, or c
  misc_feature (2634)..(2634): n equals a,t,g, or c
  misc_feature (2650)..(2650): n equals a,t,g, or c
  misc_feature (2660)..(2660): n equals a,t,g, or c
  misc_feature (2669)..(2669): n equals a,t,g, or c
gatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagkcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggscacaccaatgcaactgttgaagacatctactgcgaaggccccccagaatacaagaagcgcaaaatcaatagtctctcctcgaaggatttcgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccascgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcataaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggccgcaccgatcgcccttcccaacagttgcgcagcctgaatggcgaatggcaaattgtaagcgttaatattttgttaaaattccgcgttaaattttgttaaatcagctcattttttaacccaataggccgaaattcggcaaaaatcccttattaatcaaaagaaatagaaccganaatnggggttgaantgttgtttccaantttgggaaacaaaaantcccacttantttaaaagnaaacg

SEQ ID NO: 3646 - DNA, 2207 bp, Homo sapiens
ggcacgagcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaaccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggatttcgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccaacgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcataaaaaaaaaaaaaaaaaaa

SEQ ID NO: 3647 - DNA, 1069 bp, Homo sapiens
  misc_feature (508)..(508): n equals a,t,g, or c
ggcacgagcacagcctcaggccctgccccagacctgcagaatcagaaactctggggtgaggcctggttatctgctgtaacagaccttccagtgggttctgatgccctctagagcaggagaaccactagcttagaggttgcagtatgtttggcatcttgccatttgtgttagttcagaggaatggctgacccccatgtctcatttctaagcttcaggcagcttttctcctgggcagctgtcattctgttgaggggaatcctggggactgtggctcctcctccctgtccgtgtgtccttgatctggcagtctacccccttcatctccccgtggaggctccatgcctagaggtggtcttcaaacagaagaatggcaaagataattgtctcgtgttttaccctgaccccattcctttaagagggtcacttcttggcccattcattaaaaaccaatgtcatagttctgtgattccactatcagacagtgccacgtccaaggcgcgggctcttnacctccctggaagagagactgtgctgtctgtgcttcctgtgttctccagtcccacgctcccacggacccacgcccttggagactccctcggtgtcccagggcttctggtgtgttcagagacctccacactcaacgaccactggtgctgcagaagggccggtgcttacattccaattaacagacgcttttcccatctaatgcctcttgccttctcctaacaccacctcgggagtgtttatgtctattctaagtgaatttcactgtgtgaaaaaattcacacctgttgtcccagcgatttgggaggccggggcgggtgtatcatttgagcccaggagtttgaggctagcctgggcaggatggtgaaaccccgtctctataaagaaattttaaaaattagctgggcatagtggcacgtgcctgtagttccatctactggggaggctggggtgggaggatcgcatgagcccgggagtttgaggctgcagtgagctgtgatcgcagcactgcactccagtctgggcaacagagcaagaccctgtctcttaaaaaaaaaaaaaaaaa

SEQ ID NO: 3648 - DNA, 1154 bp, Homo sapiens
aagacaggaaaagctccaggccgtggttctcaaagtgtggtccctggacagcagcaacatcacctaggagcctgttagggaaggcacagcctcaggccctgccccagacctgcagaatcagaaactctggggtgaggcctggttatctgctgtaacagaccttccagtgggttctgatgccctctagagcaggagaaccactagcttagaggttgcagtatgtttggcatcttgccatttgtgttagttcagaggaatggctgacccccatgtctcatttctaagcttcaggcagcttttctcctgggcagctgtcattctgttgaggggaatcctggggactgtggctcctcctccctgtccgtgtgtccttgatctggcagtctacccccttcatctccccgtggaggctccatgcctagaggtggtcttcaaacagaagaatggcaaagataattgtctcgtgttttaccctgaccccattcctttaagagggtcacttcttggcccattcatttaaaaaccaatgtcatagttctgtgattccacctatcagacagtgccacgtccaaaggcggggctctyacctccctggraagagagactgttgctgtctgtgcttcctgtgttctccagtcccacgctcccacggacccacgcccttggagactccctcrgtgtcccagggcttctggtgtgttcagagacctccacactcaacgaccactggtgctgcagaagggccggtgcttacattccaattaacagacgcttttcccatctaatgcctcttgccttctcctaacaccacctcgggagtgtttatgtctattctaagtgaatttcactgtgtgaaaaaattcacacctgttgtcccagcgatttgggaggccggggcgggtgtatcatttgagcccaggagtttgaggctagcctgggcaggatggtgaaaccccgtctctataaagaaattttaaaaattagctgggcatagtggcacgtgcctgtagttccatctactggggaggctggggtgggaggatcgcatgagcccgggagtttgaggctgcagtgagctgtgatcgcagcactgcactccagtctgggcaacagagcaagaccctgtctcttaaaaaaaaaaaaaaaaactcgag

SEQ ID NO: 3649 - DNA, 1197 bp, Homo sapiens
  misc_feature (573)..(573): n equals a,t,g, or c
  misc_feature (1177)..(1177): n equals a,t,g, or c
  misc_feature (1185)..(1185): n equals a,t,g, or c
aagacaggaaaagctccaggccgtggttctcaaagtgtggtccctggacagcagcaacatcacctaggagcctgttagggaaggcacagcctcaggccctgccccagacctgcagaatcagaaactctggggtgaggcctggttatctgctgtaacagaccttccagtgggttctgatgccctctagagcaggagaaccactagcttagaggttgcagtatgtttggcatcttgccatttgtgttagttcagaggaatggctgacccccatgtctcatttctaagcttcaggcagcttttctcctgggcagctgtcattctgttgaggggaatcctggggactgtggctcctcctccctgtccgtgtgtccttgatctggcagtctacccccttcatctccccgtggaggctccatgccwagaggtggtcttcaaacagaagaatggcaaarataattgtctcgtgttttaccctgaccccattcctttaagagggtcacttcttggcccattcatttaaaaaccaatgtcatagttctgtgattccacctatcagacagtgccacgtccaangcggggctctcacctccctgggaagagagactgttgctgtctgtgcttcctgtgttctccagtcccacgctcccacggacccacgcccttggagactccctcagtgtcccagggcttctggtgtgttcagagacctccacactcaacgaccactggtgctgcagaagggccggtgcttacattccaattaacagacgcttttcccatctaatgcctcttgccttctcctaacaccacctcgggagtgtttatgtctattctaagtgaatttcactgtgtgaaaaaattcacacctgttatcccagcaatttgggaggccgaggcgggtgtatcatttgggcccaggagtttgagactagcctgggcaagatggtgaaaccccgtctctataaagaaattttaaaaattggctgggcatagtggcgcgtgcctgtagttccatctgctggggaggctggggtgggaggatcgcatgagcccgggagtttgaggctgcagtgagctgtgatcgcggcactgcactccagtctgggcaacagagcaaaaccctgtctcttaaaaaaaaaaaaaactcgagggggggcccggtacccaattcgccctnatsagtgnagtcgtattaca

SEQ ID NO: 3650 - DNA, 470 bp, Homo sapiens
  misc_feature (315)..(315): n equals a,t,g, or c
ccgccgccgccgctacagcgaccctgaccgccgtccgagccgccagacacccagagagacgccagaggccgcggaggggcgaagacccggagtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagytcggggccttgcctcttgcagctactctgtggtcaggccgggtcctccaccatcaggaanatcccatcctgagctctgtctcctgcccctcctgctgtgggatgctgagcacagagcccacagcccatctgcctcttcacctccctgaatccgtgtccatctgcaataaacgacagcctcggctgcctcgtgctgaaaaaaaaaaaaaaaaaaaa

SEQ ID NO: 3651 - DNA, 470 bp, Homo sapiens
  misc_feature (444)..(444): n equals a,t,g, or c
  misc_feature (458)..(458): n equals a,t,g, or c
  misc_feature (469)..(470): n equals a,t,g, or c
ctgcaggaattcggcacgagcggcacgagtgccaatacaactgctgtcgccctcaatgcgccagcccaccctgcaaggctcctaccacctggacccgcagtagccctcctactgctccgggggagctgcagtctctgttgctgccaccaaccgcataaggcgagctgcaaagccatgccatctgcaggctccaatgtaccatagatgactcctcctcttcctcctcctccagcctggcttggagcagctagatgggcaaagctagaaaagcctaaaacgggatgcagggagtggtagcattagagcctcaccttgtcacgctggccactgggtggcagggaccagtttcagcaaaggcactcacacccaccctccaaagtccagcctctmmttctggcaaaagctggccaggaactggggcccagggtgagtgggtgtgctttnccaaaaaccagggnaggttatagcnn

SEQ ID NO: 3652 - DNA, 1821 bp, Homo sapiens
ggaattcggcacgagcgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaagtgatatcaaatgggcctctcgctgggacacttactgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggccccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtcctacaaaaaaaaaaaaaaaaaactcgagggggggcc

SEQ ID NO: 3653 - DNA, 1094 bp, Homo sapiens
ccacgcgtccggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcctgctccgtcctcggacaggaagccaccctgcgtgggggactgcaggcacgcaaaataaaataactcctgctcgtttggaatgtaaaaaaaaaaaaaaaaaaaaaaaaaaaaaaaaaaa

SEQ ID NO: 3654 - DNA, 1042 bp, Homo sapiens
  misc_feature (11)..(11): n equals a,t,g, or c
  misc_feature (15)..(15): n equals a,t,g, or c
  misc_feature (941)..(941): n equals a,t,g, or c
  misc_feature (1016)..(1016): n equals a,t,g, or c
  misc_feature (1022)..(1022): n equals a,t,g, or c
  misc_feature (1028)..(1028): n equals a,t,g, or c
ggttcgtcaanaaanctttaagaggtaccccccggaatttttgggtcgacccacgcgtccgctttcttctatttcttgtggatattatggctaataacacarcaagtttagggagtccatggccagaaaacttttgggaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtaaaacacattttcttcaaacacgttttcccttttgtttcaaaaaatgtaatattttcccccaagcgttttatatttatgtattttgtattcaatgtgaggcttattaaaaatagtgattctaatgtaagaatcagctaangatgcattatatatattttaattaaaattaaaacttcagawatttgkgggattacaatcccawttacytcccaanggggcnttaaanggggggaaaaaaaa

SEQ ID NO: 3655 - DNA, 1556 bp, Homo sapiens
tttttttttttttttttttttttttgaataaaacttgacataaatttatttttatttcacaatccacaaaacatttcaaattaaagaaatacattaaaagtctccagtttttgctttaatttcacatttcatacactcacaatatttaggaaatagtcattttgactgtcttataactgggataagggtgcagcaacaattctgccagatggttaaatgccccagaggatttctgctcttctcttcctaatttgggagctataaagcagtttttactcccaacacaaattcttgataaaaaccatactctttgctgatttttcatgttagacattaaggatgacatgcaagtaaaaaaaaaaaaaaaaaaaaaagtagccctgataccaagttaatattcccttgaaaccttacttggctgctaaatytctttgttgaaaaccaacttataacaaattggttatccggttagcttttttccctttttcttccattttcttcttgctccctctttctcttactttttccttttggcatgtttaattagagaacattttctataagcattattaagaataattgtccttaaggaatgatggataatataagggaaatgaaaataataaagaaaatgctacatggaatctcttattcttgaaccatgttcagacactattagctgtgaccactgcaataggaaatgaaaaagagggtactttttcactgaaaatcccactgttcaaagaaacaaagaaacggccacataaactaaatattcacaatactggaaatgraccacagactttttgagtaatactccagtgaactcatgtccttaaatgagaagggcagccacagacatctgcccactggaactctctggtggccacatttagggatgcattcttccttacaagggcagccacctgtggaagtggattcttaaataactgtgtgcaccaaagaccatctggcatggcttaatcactgtacagactctgcagagaagttggaattgagattcgtagagaagcaaaccaggaatgatgcctgatgattaagagtcaatccaggaaggagaattcttcatgggcaacatctatttcaataacaaactctctccccagtgactcatacttatttgtctgcaaagttacaaaagaagatccccagagaaagtgctttccaagttgctagatgtaagtttaagaaagaaaatttttcccttaagaaaaacgtgagcttggttttaaacttgaggcttgtttttaggtcaaatgaattggattttttcctgttgcttttctaacaatgtaacgacaacggtgaagaaaaggtaaatcatcatgttagtaaatccaaggattttgcctccaggaagtagataactattcttgggaaaaacacataaagagtttgtccagaaaaaattagtgtcaaaaatgaaacatccaatgacaccaaaagagttcagtttcctgtgcttgagtcccacacttcttataatgatcaaatcaaggaactttagaatgtcctatgttctgtcattttgtgcc

SEQ ID NO: 3656 - DNA, 615 bp, Homo sapiens
  misc_feature (18)..(18): n equals a,t,g, or c
  misc_feature (20)..(20): n equals a,t,g, or c
  misc_feature (584)..(584): n equals a,t,g, or c
cctgtatataaaattggncnctatggtcccgtacaatgaagaaatgcaaagatagttaagaaagactcggccttcaaggagcctaaatgtgtagaaaaggactaaggcaaaacaataacttttttgagctcttgccatgtgtgaagcactttatacacctgtaaggtaggtaacgttgttcttattaaacatgaagaaaatgagactttgtgagaagcaatacagtatagaagttaagaatatggactctaaagctagatttcagaggtttgaagtagctctgctacttactggctgtgtgactttgagcagattacttaacctgtctgtgcctatgtttacttttattgttgtaaaaagatatgcaacataaaatattccatttcaaccgtttttacgtgtatacttcactgacattagttgcattcactatgttgtgcaaacgtagggtcgctatgaagattaaatgagttaattcatataaagccctcagaagagtgtctggcacatggtgagtattggctgtactgtggtcgatgtcattgttagagagctttagtgatttgcttaagacagaaaggtanactggggtgcggtgggctcacgccctggtta

SEQ ID NO: 3657 - DNA, 1125 bp, Homo sapiens
gtaccggtccggaattcccgggtcgacccacgcgtccgcccacgcgtccgctccccagtagctgggatgaccggcactcgccaccaagcctagctaattttttttgtattttgactagagatggggtttcaccatgttagtcaagctgctcttgttttgttgttgttgttgttgttgttgttgttgtttgatactgagtctcgctccagcctggcgacagagcgagactccatctcaaaaaaaaaaaacaaaaaaaccaaaaaaaaaaacagaaaagaaacaaaaaacgttgttttaattttaattaactcaaatagcttcatgtggctagctgccgccctgtagaacagcacagttctagaactttcgagaccttctccctgttatccacacttactttacagagtagactcagcacttcgagtcccctgtccttcaggccaggccaaatcttggtccccagagcccagtgtggcagaggccatcgaaaactgacccacgcactctagcccagccctggatttacagccaagcrctgtatagggatgggtgactcttttgtttttgtttttgttttgagttgggtctctcgctctctcacccaggctggagtgcagtggcataatcatggctcgctgtagccttgacctcctgggctcgggccatcctcctgcctcagcctcctgcagaactggggctgcgggcacatgccaccacacccagctattttttattttatttttttgtagagtcagggtctcactgtgttgcccagactggtcttgaactcctggcctcaagctatcttcctgcctcggcctcccaaagtgctgggattacaggtgtgagccactgtgcctggcctcttggtgactctttgcaagggcattgctggctggctgatatggcctgcagcctctgcctgtaaccatcagagcgatactctcattatcggcaaggtgggacccmccctggcccaagagacagggcctgttattccactgtatggaggagaagctgaggcttarggaaggcagatgacttggcaaggtcataaagacagcaagctgcaggaccagctcattctaaggcatgaaccccctgggggcccaacttaccaatgaa

SEQ ID NO: 3658 - DNA, 2297 bp, Homo sapiens
  misc_feature (481)..(481): n equals a,t,g, or c
  misc_feature (1408)..(1408): n equals a,t,g, or c
  misc_feature (2248)..(2248): n equals a,t,g, or c
  misc_feature (2277)..(2277): n equals a,t,g, or c
tcagtttgccctgcatgtgtacctggccccctcctgggcggatacggcaggcaaacggtgcaagggcggctgccgggagaaggtgggcagctggagtgggactgggggagacaggatcaatgtgacctgcggtggtccccaggtggccgggatgcagtacctgcacggcgtccygggccccatcatcaacaaggtgtttgaggagaagtacgtggagctggaccccagcaaagtggawgttaaggatgtagggtgaggccgggggtaactccgggggktgcggggygcagcggcagcgggttgggatcaggccctgtcagcatgtgtgtttgtgcttctgcccacccgtgtattgtcccctgtgtccgtgtcctggctgctgtgagagccactgttcctgtcgtggccctggcgctgaccgcgacctcctctgccaacccgccccgttccacgcaggtgctccgggctgcaccgcccgcanaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgyttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggtaaaatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcrgaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacggtgnaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcaragcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaaaaaaaanaaaaaaaaaaaaaaaaaaaa

SEQ ID NO: 3659 - DNA, 482 bp, Homo sapiens
  misc_feature (455)..(455): n equals a,t,g, or c
  misc_feature (457)..(457): n equals a,t,g, or c
ttacccagcaacccaagtcatatcctgatgatatccatactcctcagtcaygcatcccgtggtgcrggggctgaccccaagaggagctgctgcccccagagggtggggagccgaggcagggcctkggtcagacttaccaggctatgctcccagcccagccctcactagggacccccgartgcatctctctcctctccargcctctgtttctccatctgtgcaaccacagtgttggacatggtartcccaagtgtctgctcgtaactttgccctctctgtgcccccaggtcagggctgcgataagacccggtcacggtgaccctgcaggagtggaatgaccctcttgaccrtgaccttgaggcccagctcatctaccggcacctgctgggcgtggaggccatgctgtgggaraggcaccgggagctgagcgagggcgcagaggcaggcacgtgctnangagccctggcaaagtccccgaggat

SEQ ID NO: 3660 - DNA, 1081 bp, Homo sapiens
  misc_feature (9)..(9): n equals a,t,g, or c
  misc_feature (17)..(17): n equals a,t,g, or c
  misc_feature (35)..(35): n equals a,t,g, or c
  misc_feature (1077)..(1077): n equals a,t,g, or c
tgcacctcncactattngggttacaaaagctgganctccaccgcggtggcggccgctctagaactagtggatcccccgggctgcaggaattcggcacgagtcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccrcacatgacaatggaccaaatgtgccacacgctcgctcttttttacacccagtgcctctgactctgtccccatgggctggtctccaaagctctttccattgcccagggagggaaggttctgagcaataaagtttcttagatcaatcaaaaaaaaaaaaaagggsggccgtctaaagwtcccccgangggg

SEQ ID NO: 3661 - DNA, 720 bp, Homo sapiens
  misc_feature (20)..(20): n equals a,t,g, or c
ccacgcgtccgctccgcggncgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggttgcctgsggacacgctgggcctctgtmctgatgctgctgagctccctggtgtctctcgctggttctgtctacctggsctggatcctgttcttcgtgctctatgawtttctgcattgtttgtaatcaccacctatgctatcaacgtgacctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaaaaaaaaaaaaaaaaaa

SEQ ID NO: 3662 - DNA, 1932 bp, Homo sapiens
  misc_feature (293)..(293): n equals a,t,g, or c
ggcacgaggccgccctgggtgtcagcggctcggctcccgcgcacgctccggccgtcgcgcasctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacancttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctatargggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgaraaaaaaaaaaaaaaaaaaaaaagggcggccgctctagaggatccctcgaggggcccaagcttacgcgtgcatgcgacgtcatagctctctccctatagtgagtcgtattataagctagg

SEQ ID NO: 3663 - DNA, 1595 bp, Homo sapiens
gcctaaagagagctcccccaggaccagccctggccaagggattgctgcagccctcatccaccttccaagcactggaaacaaacattggagaccaagtgaggcgtcactcaacagccgtagtaatcagggaaatgacaagttacatactgatatcctttgttttgctgattggagttgggtgcattgaaaaagatcagtcgtgcccagtgtttgggggaaggaagcgtcttcacctgttgtttgtgggaggacagttgaggcaggtssagctgggagctccccgacctccaggagggcaagatccaagccatcagcgactcggacgrggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaacatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtaygggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagartctcttgarcccttcttcccggttgtcttgggagaagggtgaggatgggcatttagacccgaaaccagctgctcactctttctttttggcagaaataaaaccacargtagaaaaaaaaaaaaaaaaaaaaaaaaaaaaaaaaaaaaaaaaaaaaaaaaaaaaaaaaaaaaaaaaaaaaa

SEQ ID NO: 3664 - DNA, 970 bp, Homo sapiens
  misc_feature (854)..(854): n equals a,t,g, or c
tgaagggcmcggccaatktacgctggggtaaaagttgtcawtcatgctgatgatgaattgaartccctcttggtggggcccacgatggtgcaggtcctcctgtggtgttgcccgtaccagggtagttcaccccgtccgagtcgctgatggcttggatcttgccctcctggaggtcggggagctcccagctggacatgccctgctcgccgtactggttgtagaactccatgtggctgcacgcctggatccagccaactacccaagtctccttcttggggatgggcggcatgaccacctgggccgaggcccggaagtggggtgtccggtagcggagcaccacgctggaggactcatcgatgctagtggggacggggtcgatggaggctttcacatcaatcaccgtgatcccttcccggaagactctggctttgcctccgatgctctgaatacagcccatggcatacaggagcgctctgatctccagggaaggccagcagtcacagaaaaaaccaggcattgaaaggacagaggctgcaggacccagtacagacggcgctgctctccaatctcaactctcaagaccgatatccataggatagaaaactcactgagtagactggggttgcatatatcactaccgcggcctgtttataaataaggattctgctgcatttcatgagccctgggctctctcttcttctcctcgcagtggacaaaaatcaccgatattctttgggttaaaaaaagtttgtagtttaatgaataattatgcggttctgacatccagcccttctgtgcctcacacgcggggacggcagctcgcagactctccctgaagtcttcggaggaagcangcgagcgccggcagactcataaataaggaaggctctgtccccgcgcggccgcgccaccctcgcggcagaagcctgacttcctgccctccggccttccgcacgcgctcccggcacga

SEQ ID NO: 3665 - DNA, 711 bp, Homo sapiens
  misc_feature (345)..(345): n equals a,t,g, or c
ggcacgagcgaagaccctgttcggaccctgccccgattccagactcaggtagatcgtcggcataccctctaccgtggacaccaggcagccctggggctgatggagagagatcaggtatcccccagggagtaggggctaccttgaggggatgatagacctcccccactcccagtgkkactctggaaatatgaaggaactagggagtggaagagatttcagagctggggagaggagttcctcccttcaaagccagcaactgcctttggggaatgtcggggggtctctcctttctcctgcttgtttraggtggtacacagtccccccttcamctggsgggaagctgtnccggacaractcatctcagctttcccttggggcaggatcgggggcagcagctccagcagaaacagcaggatctggagcaggaaggcctcgaggccacacaggggctgctggccggcgagtgggccccacccctctggragctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaaaaaaaact

SEQ ID NO: 3666 - DNA, 973 bp, Homo sapiens
ggcacgagcccagcggaagccaagccaccaggccccccagcgtccacgcggagcatgaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgc

SEQ ID NO: 3667 - DNA, 984 bp, Homo sapiens
gaattcggcacgagcccagcggaagccaagccaccaggccccccagcgtccacgcggagcatgaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagamctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgargggctggtcaacctgcgctacctcaacctgggcatgtgcaacctcaaggacatccccaactgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgta

SEQ ID NO: 3668 - DNA, 826 bp, Homo sapiens
  misc_feature (651)..(651): n equals a,t,g, or c
gctcagttaagcactgagtttggcgctgttactatttgcttgccatgtttttttctggtctcctccgaggaaactaggatattgctgccttgcttaaaatctggctaagccctactccacgtgacatgcaaggccctttgtgacctggtcccttaggtcaagcctcccctcccactcctgccccaccacccagcagccagcccactgggtgcaggccaggcccctcccacatggaatcctccaccgggaaggcctctccccgttgccacatccactgtgttcctccttttcctcctccctgcccagtcaagagagttggtcgtttattcctcttttttcagcatttcccacagggcactgtaataattcctttgatgcctagccccccactagactaactggagaggggcccgccgcttcctgcctggtgtctagctcacagaggggacgcagggagtgcaggttgcgtgagtgcctcactgcttccttccctcgctcatctcctctctttgctgtgccccaggccatgaggtttcctcccaaatcgtacaacaaggacttggagtctgcagaggtaagctctctgctttctgggtgagaccgaaaggtcaaacttycacacagaaggggagtcgggcgagtgtctggaanggctgagctgctctgaagctttggcctcacttgsctctctccccaggaacggcgtgacgagaacagcaggacttggagtttgccaaggagatggcagaagatgatgatgacagcttcccttgagctggggggctggggaggggtagggggaatggggacaggcactttccccctt

SEQ ID NO: 3669 - DNA, 4400 bp, Homo sapiens
gtatcaacccaatgaagcgataagggaagatttatcagcaagactgttgaacgcataactgcccaagatgcctgtycctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggmccgacgtgggctcaaagcctgatagcattcctcctccagtacctagtactccaagacccattcaatcaagtctgcacaaccgggggtccccaccagtgcccggagccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggctgcctcacaggccccacctccgccgccacctcccagcaggcccgggmcgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagrtataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatgaaaaaaaaaaaaaaaaaaaaaaaaaaa

SEQ ID NO: 3670 - DNA, 1614 bp, Homo sapiens
ggtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggaggggcaaagcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctaaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcct

SEQ ID NO: 3671 - DNA, 1087 bp, Homo sapiens
  misc_feature (14)..(14): n equals a,t,g, or c
  misc_feature (55)..(55): n equals a,t,g, or c
  misc_feature (63)..(64): n equals a,t,g, or c
  misc_feature (174)..(174): n equals a,t,g, or c
caagttaaagtaangtggccccggcaaccaataagtgttgtttttggaagggctngaaagttnnaaagcgagggcttgtaaaggggaagatgggaccgttgtgaaggaaggatgattggggctttgaagcaaaagtgggggaagggggcaaaggcagttggcccaacacattcnccacccctttgagaggtctgaggcctgcagacctggctcggagcccacctggtagtcctcagactgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagkcctctctgagcctctgcttcccatctggaccctgctgggcagggcttctragctccttagcactagcaggaggggctccaggggccctccctccatggcagccaggacaggactctaaaatgaggacagcagagctcgtggggggctcccacggacccgccktgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgtcaagtaaaatccctgccctcacctatcccaccctactacacagagatgtcctctcgagg

SEQ ID NO: 3672 - DNA, 1201 bp, Homo sapiens
  misc_feature (66)..(66): n equals a,t,g, or c
  misc_feature (1182)..(1182): n equals a,t,g, or c
  misc_feature (1184)..(1184): n equals a,t,g, or c
gaattccggaacaaawgcyggagctccaccgcggtggcggccgctctagaactagtggatcccctnkgctgcaggaattcggcacgagctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtktgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtgccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatttggctaagcatacacactgttgcactggagggcctgaaccagccatcaaacgagagcctgcagaaggtncncagtaaggctgaagttt

SEQ ID NO: 3673 - DNA, 628 bp, Homo sapiens
  misc_feature (567)..(567): n equals a,t,g, or c
  misc_feature (596)..(596): n equals a,t,g, or c
ttgggaagctggtmcscctgcaggtaccggtccggaattcccgggtcgacccacgcgtycgttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggaggtcagaaaatatttttttaaatataaaaagaaagttgtgagataaccatataggcagtttctagttttcggacagtactcttagaaatccagataacaaagtggcaccccttcgatattctcccctatccctgtgcataattatgtaattatcagcttggttcttggtgaaacctgaataaatgctttttgatgcaaaaaaaaaaaaaaaagaaaaataaaaaaaaaagataaaaaaaaaccttaaaaaaaaanaaaaaaaaaaaaaaaaaaaaaaagaaaanaaaaaaaaaaaacaaaaaaaaaaaaaaaaaaa

SEQ ID NO: 3674 - DNA, 425 bp, Homo sapiens
  misc_feature (367)..(367): n equals a,t,g, or c
  misc_feature (380)..(380): n equals a,t,g, or c
  misc_feature (408)..(408): n equals a,t,g, or c
atcgtgctcaagtacatcatggctggttgccccttgtttctgggtaatctctgggatgtgactgaccgcgacattgaccgctacacggaagctctgctgcaaggctggcttggaagcaggcccagggccccccttctctactatgtaaaccaggcmcgccaagctccccgactcaagtatcttattggggctgcacctatacctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaaccncagataataaagntacatccatttaaaaaaaaaaaaaaaancccgagggggggcccgg

SEQ ID NO: 3675 - DNA, 1016 bp, Homo sapiens
  misc_feature (1)..(1): n equals a,t,g, or c
ncggacgcgtgggaggcacaggcctgagaagtctgcggctgagctgggagcaaatcccccaccccctacctgggggacagggcaagtgagacctggtgagggtggctcagcaggaaggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacttggggaaatcaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccacctgcaggaagaaagttttcagagtcgtctcggccactactccctgtcacagtttattgaatctgggccggagatgtccagggggtcaattcaatcccgcacagggtagttcaagctgacatctaaggacgtgagttcgttcaacggagaacgaagaatggtcacaacacaggtgagcataagggtaccgcgatggtcgcatggagggaccacgtgttgggttgtagggcacacaaacgaccaaggcatcctggagcacaggatatcgcgagaatcaaagccgaaggtccaaacactagtacagttgaggaacgggatgtgaaatagtacgaggcaaataacacccggggttccacatgaaatagctttttctcgcctcttccctcccccttcctctgg

SEQ ID NO: 3676 - DNA, 1490 bp, Homo sapiens
  misc_feature (1)..(1): n equals a,t,g, or c
ngccaggaaggcacaggcctgagaagtctgcggctgagctgggagcaaatcccccaccccctgtctggaggctgctagactcctatcttctgaattctatagtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaacaaacacaacccccgatcatataaacgcagcacacttcacccaccggcactacccgccacgccagccacccccaccacaaacggccgctccttacccg

SEQ ID NO: 3677 - DNA, 1441 bp, Homo sapiens
aggaaggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacttggggaaatcaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaaaaaaaaaaaaaaaaaaaaaaaaaaaaaaaaaaaaaaaaaaaaaaaaaa

SEQ ID NO: 3678 - DNA, 1516 bp, Homo sapiens
  misc_feature (34)..(34): n equals a,t,g, or c
ttcacgtgcacactgatcacaacgtcacgcctgncagggcaccggtccgggaattcccgggtcgacccacgcgtccgcaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacttggggaaatcaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaatcttaaaaaaaaaaaaaaaaaaaaaaaaaaaaaaaaaaaaaaagggcggccgc

SEQ ID NO: 3679 - DNA, 1381 bp, Homo sapiens
gataactcaggcccggtgcccagagcccaggaggaggcagtggccaggaaggcacaggcctgagaagtctgcggctgagctgggagcaaatcccccaccccctacctgggggacagggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaatcttaaaaaaaaaaaaaaaaaaaaaaaaaaaaaaaaaaaaaaa

SEQ ID NO: 3680 - DNA, 1439 bp, Homo sapiens
cccacgcgtccgcaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacttggggaaatcaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccgggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaatgcttggtgtctggctgggggacaaccaagacccccaagtgcacttccctaaggtcctccagtgcttgaatatcacgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaatcttaaaaaaaaaaaaaaaaaaaaaaaaaaaaaaaaaaaaaaa

SEQ ID NO: 3681 - DNA, 1191 bp, Homo sapiens
gctgggctggaacacaagarcccacagggctgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggccctgctgaccctgcctgtggcctacatcatcacagaccagctcccagggatgcagtgccagcagcagagcgtttgcagccagatgctgcgggggttgcagtcccattccgtctacaccataggctggtgcgacgtggcgtacaacttcctggttggggatgatggcagggtgtatgaaggtgttggctggaacatccaaggcttgcacacccagggctacaacaacatttccctgggcatcgccttctttggcaataagataagcagcagtcccagccctgctgccttatcagctgcagagggtctgatctcctatgccatccagaagggtcacctgtcgcccaggtatattcagccacttcttctgaaagaagagacctgcctggaccctcaacatccagtgatgcccagraaggtttgccccaacatcatcaaacgatctgcttgggaagccagagagacacactgccctaaaatgaacctcccagccaaatatgtcatcatcatccacaccgctggcacaagctgcactgtatccacagactgccagactgtcgtccgaaacatacagtcctttcacatggacacacggaacttttgtgacattggatatcaataaggccaggcgtggcggcgattacgtctgtaatcccaggactttgggaggccaaggcgggcagatcacttcaggccaggaattcaagagcagcctggccaatatggcgaaactctgtctctactgaaaacaaacaaacaaacaaacaaacaaacaaagaaacaacaaaaattagccgggtgtggtggcacacgcctgtagtcccagctactcaggaggctgaggcataagaattgcttgaaccctggaggcggaggttgcagtgagctgagattgggccaccgcactccagtctgggagacagagtgagactgtctcaaaacaacaacaaaaaaatccctaacataatctcaaaaaaaaaaaaaaaaaaaaaaaaaaaaaaaagggcggccgc

SEQ ID NO: 3682 - DNA, 1626 bp, Homo sapiens
  misc_feature (525)..(525): n equals a,t,g, or c
  misc_feature (542)..(542): n equals a,t,g, or c
  misc_feature (562)..(562): n equals a,t,g, or c
  misc_feature (607)..(607): n equals a,t,g, or c
ccacgcgtccgacgcggcgcacgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggratgacgcccgtgcctaatgtgcytkgsgggggraaacgactgncccacsggagggaagantggggagtttttccgcccgnaggggggcttgaarggtccaagtttaccccatggggggaactggnttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgmacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagaccctgtctcaaaaaaaaaaaaaaaaaaaaaaaaaaaaaaaaaaaaaaa

SEQ ID NO: 3683 - DNA, 549 bp, Homo sapiens
  misc_feature (496)..(496): n equals a,t,g, or c
gggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgnccgccggggatacctaccaagatcctgcatgtcttccatggccttcttcctgg

SEQ ID NO: 3684 - DNA, 1120 bp, Homo sapiens
  misc_feature (6)..(6): n equals a,t,g, or c
  misc_feature (13)..(13): n equals a,t,g, or c
  misc_feature (17)..(17): n equals a,t,g, or c
  misc_feature (1020)..(1020): n equals a,t,g, or c
  misc_feature (1084)..(1084): n equals a,t,g, or c
cttaancgggggnccanggggaaaactcgtgacmytatagaaggtacgcctgcaggtaccggtccggaattcccgggtcgacccacgcgtccggagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggacccacctggcaggggtggtcagcggncgggatgccggcgtggccaagggtgccagcatgcgcagcctgcgcgtgctttcccaaaaaaaanccccttttggggggccccccccaaaaaaaggggggg

SEQ ID NO: 3685 - DNA, 1893 bp, Homo sapiens
  misc_feature (1)..(1): n equals a,t,g, or c
  misc_feature (5)..(5): n equals a,t,g, or c
  misc_feature (1853)..(1853): n equals a,t,g, or c
  misc_feature (1871)..(1871): n equals a,t,g, or c
ngggntttttttttttttttttttttttaggacaacgtttgtttgtttttattttaaaaagtcaccatattaataaaaatgctacaaaacccagaataaatatcttcaagttacaaaagcaaaacaggtctagaaaagttggctgtaaaaaggcaacagagaggacagacccaaaagataaatgtctgcttgcttgggtggggctggtgctcaaggagggacagttgttggccctctcccccgaccatgccttagaagcatctccgccaggccagtgaatcaggcctgggtgataacggaaaaagttccatgcctgcaggcatcgttctgccatcactcaccgagcttcctggtctgtgttccccttcccagcctcactgttacccgtaaaaatgaggagcccagccgggtgaagtaagaagaggcttggcttcagagccagcccaatctgcgtttctggctcagttcctgctgtgtgagcttggcaggcacgccccctctggttccaggtttcttcctctgtgaagtaggggtgcgaakwgtgtactgccgggtagtggagcgggttggctgagacagtgcatgcaccactgcacactgccgagtcagtcctaggtgatggctccccgcaggccacctttgggtgttgctagcacagcctggcatagagcagagtaaaggtggctcaggaaaccaagcacagcctgtgaccaccaggggcrcacctgtctccagctctggctagatgccatccagaaagctaagcctccattaatcagggagcccccaggggcttctccacagttagctggagatgagggccatcagcacctttcacactmaccccccaacgatgtttgtccctgcagcccctaccgccccctcccctatccatgggaagaatcctgcctccttggtggagacctgaggattgaatgcctggcacggaacaagagctcaataaaagtcattctgcccacggacatcggcacattgggagcagctggcagcacccgagcacagctcgacctgtttgaatggtgaaatgccccacagtgagggagggagcttcctggcacctccacctggggaggaggcacccagagtgagtgagttccaggcaaggaggctgccccactcaagggccaggccagcagccccggaaaggcggaagcatccccatcccctcgtgccaggccatggagggctgagagagggacaagtcggaaccattttaaagctcagccccagcccttgaccctccccagacacccatcctgggatggggctgtcactggagctcctgggaggcctgcgccaggtgccggctccggcagcagatggcaacggctgtcacggcctcttcgctggtgctgcctgtagtgctgacgtcccggctcctgactacacacgtgttgtctacggcgtaggcccccaggacgtgggaggtcccagggagggcactgcagccagtcagggtccagccctcctcgcaggccacggtcacctgctcctgaggggccgggattccatgctccttgactttgcattccagacctggggcatggcagcaggaagcgtggatgctggcctccctgtggcccacgcactggttgggctgacctcgtggcctcagcacaggcggcttgtgggtrccaarrtcctccacctcccagtgggagctgcagcctgtgaggacgtggccctgttggtggcagtggacacgggtccccatgctggcctcagctggtggagctgtgtggacgctgcagttggcctggggtagcagacagcacctggcaatggcgtagacaccctcacccccaaaagcgttgtgggcccgggagcccaanttsaaagaagattccccnttcccccccstcccccgtgtgc

SEQ ID NO: 3686 - DNA, 1187 bp, Homo sapiens
  misc_feature (39)..(39): n equals a,t,g, or c
  misc_feature (46)..(46): n equals a,t,g, or c
  misc_feature (1052)..(1052): n equals a,t,g, or c
  misc_feature (1108)..(1108): n equals a,t,g, or c
  misc_feature (1129)..(1129): n equals a,t,g, or c
  misc_feature (1138)..(1138): n equals a,t,g, or c
  misc_feature (1158)..(1158): n equals a,t,g, or c
  misc_feature (1172)..(1172): n equals a,t,g, or c
gcacccacctggcaggggtggtcagcggccgggatgttnggcgtgntcaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaggaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtgtggtcagcacactcggggcctacacggatggccacagccatcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtycacacagcttcaccagctgaggccagcatggggacccgtgtccactgcaccaacagggccacgtcctcacaggctgcagcttccactgggaggtggaagaaccttggcacccacaagcccgncttgtgctgaagccaccaaggtcaagcccaaccaagtgccgtgggccacaaggganggccaagcattccacgctttncttgcttgncattgcccccaagtcttggnaatggcaaaagtcnaaggaagcattggga

SEQ ID NO: 3687 - DNA, 1286 bp, Homo sapiens
  misc_feature (1149)..(1149): n equals a,t,g, or c
gactgctttacggacattggatgaagccgaagcatttagaatggtgcctggcacacagttggtgcgtgatatggttaagctttgtgtccccacccacatctcatcttgaatgtgacggtttccccggctccctcctgccgccatgtgaagaaggtcgttgcttccccttcaccttccaccaccatgattgccatggatgctccccactccaaagcagccctggacagcattaacgagctgcccgagaacatcctgctggagctgttcacgcacgtgcccgcccgccagctgctgctgaactgccgcctggtctgcagcctctggcggggacctcatcgacctcatgaccctctggaaacgcaatgcctgcgagagggcttcatcaccaaggactgggaccagcccgtggccgactggaaaatcttctatttcctacggagcctgcataggaactcctgcgcaacccgtgtgctgaagaggatatgtttgcatggcaaattgatttcaatggtggggaccgctggaaggtggagagcctccctggagcccacgggacagattttcctgaccccaaagtcaagaagtattttgtcacatcctacgaaatgtgcctcaagtcccagctggtggaccttgtagccgagggctactgggaggagctactagacacattccggccggacatcgtggttaaggactggtttgctgccagagccgactgtggctgcacctaccaactcaaagtgcagctggcctcggctgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcaagtgaggnccctgtaccaagcgacttctgccccggttcaaccctaccaagcttgggggaacttactgcacatagctctgacgttttgttgtaataaatgttttcaggccgggcaaaaaaaaaaaaaaaaaaaaaaaaaaaaaaaa

SEQ ID NO: 3688 - DNA, 2351 bp, Homo sapiens
ccacgcgtccggcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgtgactattcctatatcactgtgggtgatattgcaacacttagtgcattatacacaacctgaactacaaaaaccaataataaggattctttgggatggtacctatttacagttttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaagtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttgatttggcgtttaccttttcctaacatataggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggacttttttttttttgagacagacagagtcttgctctgtcacccaggctggagtgcagtggcgcaatctcgggtcactgcaagctctgcctcccaagttcatgccattctcctgcctcagccctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttaaaaaaaaaaaaaaaaaaaa

SEQ ID NO: 3689 - DNA, 1001 bp, Homo sapiens
cgcgctggaaccctgtggcggcggccatggccatatggcgctgcccgcctggctgcagccaggtataggaagaatgcgtatcttttcatctattacttaatccagttctgtggccactcttggatatttacaaatatgacagtcagattcttttcatttggaaaaggtaaaactccgaaacagtttttttatttttaacttttaatccttgttttcacctcatcctgcttatattaaatttctacacacctcaaccttctaccacgggatacagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgtcttttggaatctattggatatggttaggtacacttatagcatgttatcagtcataggaatatcctatgctgtcttgacatggctcagtcaaacactatggatgccaatttatcctttgtgtgttcttgctgaagcatttgccatctatcaatcgctgccttattttgaatcatttggcacttattccaccaagctgccctttgacttatccatctatttcccatatgtgctgaaaatatatctcatgatgctctttataggtatgtattttacctacagtcatctatactcakaaagaagagacatcctcggaatctttcccattaaaaaaaagaagatgtgaagtacagcattccagtgtgacacgagaaaagacaggctgtggattcagtgcagtaaataaaacacaggaagtattctggtggaaaaaaaaaaaaaaaaaaaaaaaaaaraaraaaaaaaaawaaaaaaaaaaaaaaaaaaaaaaaaaaaaaaaaaaaaaaaaaaaaaaaa

SEQ ID NO: 3690 - DNA, 669 bp, Homo sapiens
ccacgcgtccggacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgccttttggaatctattggatatggttaggtacacttatagcatgttatcagtcataggaatatcctatgctgtcttgacatgggctcagtcaaacactatggatgccaatttatcctttgtgtgttcttgctgaagcatttgccatctatcaatcgctggcttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtggaaaaaaaaaaaaaaaaaaaaaaaaaaaaa

SEQ ID NO: 3691 - DNA, 417 bp, Homo sapiens
ccacgcgtccgctcctctagaggctccacatgaagtcccagtgctacagtcctagttattttgccttcttctgcctggttttctttcagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaaaaaaaaaaaaaaaaaaaaaaaaaaaaaaaaaaaaaaaaaaaaa

SEQ ID NO: 3692 - DNA, 1356 bp, Homo sapiens
  misc_feature (1231)..(1231): n equals a,t,g, or c
cccacgcgtccgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagaggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggaggatacatataatatggtgtagaaatcattgaaaatggatcctttttgacgatcacttatatcactctgtatatgactaagtaaacaaaagtgagaagtaattattgtaaatggatggataaaattggaattactcatatacagggtgggattttatcctgttatcacaccaacagttgattatatattttctgnatatcagcccctaataggacaattctatttgttgaccatttctacaatttgtaaaagtccaatctgtgctaacttaataaagtaataatcatccaaaaaaaaaaaaaaaaaaaaaaaaaaaaaaa

SEQ ID NO: 3693 - DNA, 1949 bp, Homo sapiens
  misc_feature (1130)..(1130): n equals a,t,g, or c
  misc_feature (1948)..(1948): n equals a,t,g, or c
gctacgccgtgggcacttcctcaacgacctgtgcgcgtccatgtggttcacctacctgctgctctacctgcactcggtgcgcgcctacagctcccgcggcgcgggctgctgctgctgctgggccaggtggcgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtaygcagcggctgtgctgctgggtgctggctgtgccaccatcctcgtcacctcgctggccatgacggccgacctcatcggtccccacacgaacagcgganckttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcaaaaaaaaaaaaaaaaaaaaaaaaaaaaaaaaaaaaaaaaaaaaaaaaaaaaggggggggggctagttnt

SEQ ID NO: 3694 - DNA, 1487 bp, Homo sapiens; identical to SEQ ID NO: 2075
  misc_feature (78)..(78): n equals a,t,g, or c
  misc_feature (948)..(948): n equals a,t,g, or c

SEQ ID NO: 3695 - DNA, 1525 bp, Homo sapiens
  misc_feature (78)..(78): n equals a,t,g, or c
ccgctgctgataactatggcatcccccgggcctgcaggaattcggcacggagctacggcgccgcctggctcctgctgncacctgcaggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggasgagccaggcgagcacacccccctgttggcccctgccacggcccagcccctgctgctctggaagcactggctccgggagcsggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggactktcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccarggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcaaaaaaaaaaaaaaaaaaaaaaaaaaaaaaaaaaaaaaaaaaaaaaaaaaacccaccgtccgc

SEQ ID NO: 3696 - DNA, 1063 bp, Homo sapiens
  misc_feature (444)..(444): n equals a,t,g, or c
  misc_feature (962)..(962): n equals a,t,g, or c
ggtcgacccacgcgtccggcagtgaacactctttgctaaatttctgactgaatccaagatttttccttagaatagattcttaaaagtgggggccaggtgcggtggctcacacctataatcccagcaccttgggaggccgaggtggccagatcattgaggtcaggagtttgaaaccagcctggccaacatggtgaaaccccgtctctactaaaaatacaaaaattagccaggtgtgtggggcgtgcgcctgtagtcccagctacttgggaggctgaggcaggagaatcgcttgagcctgggaagcagaggttgcatgggccgggatcacgccactgcactccagcctgggtgacagcaagactccatctaagaaaacaaaaaaaaaaagtacgattggtgcgccagagtgaacacaaaatgtaaagacttgtgtatttgtgaganccttttgaagcatgctatctccccagctamaccctcttcaggtgcccctttcctgctcctcctgcttttcaaactgtggctcgtggttccaggctcaagcacggacatcagtraggactgggagaaagactttracttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtytgaggtgacaggtggtgggaaaggagctggagcttcctgctcagacccacaacattggtcatcagcaggytgcacttttcctcagttccagggtggatagagggtcaagttcttgaccttagctctgtatcaaaattgcctgagaaactgcttaagaaaacagatgtcatgctgagcacggtggctcacacctgtaatcccaacactttgggaggnccaaggtgggaggattgcttgaggcgaggagttcaagaccagcctggccaatatagtgagaccccatttctgtttttgaaaaaaaaaaaaaaagggcggcc

SEQ ID NO: 3697 - DNA, 1311 bp, Homo sapiens
  misc_feature (1036)..(1036): n equals a,t,g, or c
  misc_feature (1112)..(1112): n equals a,t,g, or c
  misc_feature (1168)..(1168): n equals a,t,g, or c
  misc_feature (1223)..(1223): n equals a,t,g, or c
gaaaaaagaaagcaatatggaaaccgaactaaggagattttaaactgagatataagatgctttcaattattcccaatgacaggctatttatcaatttaatatttttaagcaacttcctcccatcagtgctctgggaaccagctgggcagatgtggtacacccatgtcagataccccagtggcaggctcctgtcactgtagcacttggtccctccatccctcccagccttcctagctccttgctcctggaaacctccccccatcaatctctgacatttcagaggaaatactgtttgtcacctcttaaggaatctgggaggacggcctgtgagatatggcgtcagttacagcctcttaaagagtcaatagcccctgcagaggccagaacactggaacaaatgtaaggaaggtatagtttttaaagatttttgacttgaattaaataggattggttacttcttgcccctcccgagggtggactgtgcacagaagagacctcttcaccgggtttgctgctctttttcgcactgtgagttggggttctaacagtcagcgttggtccataacaaaatggaaatcctttctttcccctcctgttaatgccccctgtctgtgcagtgactgtgcaaccagcaccttttgtggtcgaatcagccagcagaagtgcccctcgtgttcctggattctctcttctgtggttccatttctttgagtcctgggttctcgccctgaatggctcaacagggggaaaggcagacagcttcttcgtgccagaaacatttttttttttttttgaaatartgagccaagattgcgccactgcattccatcctcagcaacagarcaagactccaactcawaacaaaacaaaagattgargtwattgtggcaacacctgcctttttttctaagctgcaattctctactgttttcaagaaaaatacaagttagcctatttacagaatgttttgaattgactcctgtcctctggttaaaactcctcttgagataattgatagctgaaaaggtaggatggntctctcaaacttgacttccatctaaatcaacgctgagttgattaacttagatatcaagaaaaattgcctcattagnttacccctgaggagatgcctatgaaggtacatcctttttacaattaataagacagntttcacatgaagaaacaatttgaaatatttaataagaaaatggggtgaaggcaancattacggttgggaaaagaccatgcaagcctttatagaggataacgatttatatattcactattaatttggccgggtaataggaacct

SEQ ID NO: 3698 - DNA, 1050 bp, Homo sapiens
ccacgcgtccggccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctagactggcgctcctcgccgcttccggcggtcagtgccccgaggtgaggcggcgggggcggtgcagacctggcgcgggcgctggcgcatctgctggagccgaacgtcaggagcgggcgcgggccgaggcgcagaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctagcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagcaaaaaaaaaaaaaaaaaaaaaaaaaaaaaaaaaaaaaaaaaaaaaaaaaaa

SEQ ID NO: 3699 - DNA, 718 bp, Homo sapiens
  misc_feature (1)..(1): n equals a,t,g, or c
  misc_feature (678)..(678): n equals a,t,g, or c
  misc_feature (687)..(687): n equals a,t,g, or c
  misc_feature (699)..(699): n equals a,t,g, or c
  misc_feature (708)..(708): n equals a,t,g, or c
natccccctggctgcaggaattcggcacgaggaactctgagcaccgtggcttccagcatcaatgccttggcaacagtgacctttgaggattttgtcaagagctgttttcctcatctctccgacaagctgagcacctggatcagtaaaggcttatgtctcttatttggcgtgatgtgtacctctatggctgtggctgcatctgtcatgggaggtgttgtgcaggcttccctcagcattcacggcatgtgtggaggaccaatgctgggcttattctccctgggaatcgtgttcccttttgtgaattggaagggtgcactaggaggtcttcttactggaatcaccttgtcattttgggtggccattggggccttcatttaccctgcaccagcctctaagacatggcctttgcctctatcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactggttaattagaccagtttgtaatttaatttgcttttggtctaagaaagtacaaaaccactatgctgngtgtggagntcagcatgacantggggacanagcaggaaaa

SEQ ID NO: 3700 - DNA, 614 bp, Homo sapiens
  misc_feature (52)..(52): n equals a,t,g, or c
aatcccaaaggttgtctttaaatatttctcaaaagagaaagccttgaaagangcatacaatagagtaaaaatwaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattctgtgaatattgaaatctgagccaaaactagttagctttattaatatcttagggaaagaagagagaaagaaagagggagggagagagagaaagaaagaaagaaagaaagaaagaaagaaagaaagaaaaaaaaaaaaaaaaaactcgtag

SEQ ID NO: 3701 - DNA, 465 bp, Homo sapiens
ggcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagarccggccaccctctggccgaargctctctccccaragtgcctaccctcgcctgcctgggcctyagtttccacatctgcacaatgggggtgaccatccctgccctgctggctgcaggarcggctgtgagtcttcagcgtggatgcagcctgggggaagccatagggcagctttcacaggcctggccttaccatgggcgggagggagaccgcatccgaagaggag

SEQ ID NO: 3702 - DNA, 1194 bp, Homo sapiens
gagcccagcaacgtgcaaggggaaaggggacaggattctggatggccatttgcttcactgggatgcaaaacctcttttgagtactagaatcagtatttcttcttccatctctgctgtacctgagaagaaatggccaaacgcaccttctctaacttggagacattcctgattttcctccttgtaatgatgagtgccatcacagtggcccttctcagcctcttgtttatcaccagtgggaccattgaaaaccacaaagatttaggaggccattttttttcaaccacccaaagccctccagccacccagggctccacagccgcccaacgctccacagccacccagcattccacagccacccagagctccaacagccaactcaaacttctccagtgcctttaaccccagagtctcctctatttcagaacttcagtggctaccatattggtgttggacgagctgactgcacaggacaagtagcagatatcaatttgatgggctatggcaaatccggccagaatgcacagggcatcctcaccaggctatacagtcgtgccttcatcatggcagaacctgatgggtccaatcgaacagtgtttgtcagcatcgacataggcatggtatcccaaaggctcaggctggaggtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagtttttcattcagcaagtctgcactagggacctactatgagccacgcaatacttccttggaatgatgtattccctggccttgaaataaggaatctagtacccatgtttgtgctactggaatgaatccattaaactctctgagactcaaaaaaaaaaaaaaaaaaaaaaaaa

SEQ ID NO: 3703 - DNA, 2334 bp, Homo sapiens; identical to SEQ ID NO: 1390
  misc_feature (2278)..(2278): n equals a,t,g, or c
  misc_feature (2290)..(2290): n equals a,t,g, or c

SEQ ID NO: 3704 - DNA, 720 bp, Homo sapiens; identical to SEQ ID NO: 3661
  misc_feature (20)..(20): n equals a,t,g, or c

SEQ ID NO: 3705 - DNA, 759 bp, Homo sapiens
  misc_feature (16)..(16): n equals a,t,g, or c
  misc_feature (22)..(22): n equals a,t,g, or c
  misc_feature (36)..(36): n equals a,t,g, or c
  misc_feature (51)..(52): n equals a,t,g, or c
  misc_feature (57)..(58): n equals a,t,g, or c
ggattaacaaattttncacacnaggaaaacaggttnttgacccaattaggnnttttnncaaaaaagcttatttttaggttgacacttattagaagttacgccttgcaggttaccggttccggaattcccgggtcgaaccccaaggggttcgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggaaaaaaaaaaaaaaaaaaaaaagggcggccgc

SEQ ID NO: 3706 - DNA, 628 bp, Homo sapiens
  misc_feature (50)..(50): n equals a,t,g, or c
  misc_feature (55)..(55): n equals a,t,g, or c
  misc_feature (543)..(543): n equals a,t,g, or c
  misc_feature (594)..(594): n equals a,t,g, or c
  misc_feature (617)..(617): n equals a,t,g, or c
aaacgtcacttttaggtgacactatagaaggtacgcctgcaggtaccggntccgnaattcccgggtcgacccacgcgtccgcacgtcagggggcagtcattgctacggggaatactaaatgatggcatgagaagagaaaggggtgctgtccaacaagaggttttggaaggaggcttctggaagtgtgagctgggagcaggggtttggggaggcatctccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggmcctgtggctgaggcggggctttggcttttgcactgagagaagtgggagaggacttgactcgggttcccatgctccccctggtggccatgtggtgamcagatggtggcangtkagtgagaactccagtccaggacagtggtgaccatgcagggatcaggangcaagcggtggttggatttgganggcttcctgaa

SEQ ID NO: 3707 - DNA, 990 bp, Homo sapiens
gcatgccagtgcctactctgtgcctgctgtgggccctggcaatggtgacccggcctgcctcagcggcccccatggscggcccagaactggcacagcatgaggagctgaccctgctcttccacgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccaggaacttcgggcaagcctgttggagactcagatggaggaggatattctgcagctgcaggcagaggccacagctgaggtgctgggggaggtggcccaggcacagaaggtgctacgggacagcgtkcagcggctagaagtccagytragragcgcctggctgggccctgcctaccgagaatttgaggtcttaaaggctcacgctgacaagcaagagcccacatcctatggccctcacaggccacgtcagcggcagaggcgggagatggtggcacagcagcatcggctgcgacagatccaggagaggtgagcctggcaggggtttggcaggcagggcagttggatggggggcgcacagggcagctggaaaggggccccctcacctgggctgagccacatctccctccccagactccacacagcggcgctcccagcctgaatctgcctggatggaactgaggaccaatcatgctgcaaggaacacttccacgccccgtgaggcccctgtgcagggaggagctgcstgttcactgggaymagccagggcgccgggccccacttctgagcacagagcagagacagacgcaggcggggacaaaggcagaggatgtagtccccattggggaggggtggaggaaggacatgtaccctttcatgcctacacacccctcattaaagcagagtcgtggcatctcaaaaaaaaaaaaaaaaaaaaaaaactcgta

SEQ ID NO: 3708 - DNA, 1038 bp, Homo sapiens
  misc_feature (963)..(963): n equals a,t,g, or c
  misc_feature (1025)..(1025): n equals a,t,g, or c
gcaacaagagccacctctgggtgraggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccayccccacaacttcccttttgctacttccccaaggctcttgcagagctagggctctgaaggggagggaaggcaacggctctgcccagagccatcctggagcatgtgagcagcgctggctntttcctccaccttgggcagcacaggaggcctgggagggggaaatcagcagtcggccctgagntttgcctggcccc

SEQ ID NO: 3709 - DNA, 1932 bp, Homo sapiens
aatttttttttttttttttttttttttgaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacaaaaaaaaaaaaaaaaaactcgag

SEQ ID NO: 3710 - DNA, 647 bp, Homo sapiens
  misc_feature (525)..(525): n equals a,t,g, or c
  misc_feature (578)..(578): n equals a,t,g, or c
  misc_feature (581)..(581): n equals a,t,g, or c
  misc_feature (620)..(620): n equals a,t,g, or c
  misc_feature (629)..(630): n equals a,t,g, or c
gtgaaacgcctgggctcaagctgattcacctgcctccacctcccacagtgctgggattacaaacatgatcccccacgcccagccaacacaaaacttctgatgctctgttttctcatctgtgaactggagctaaggctaagtggtctgtctgtttaataagagtttgaatcagatggcctggcatgaagagtcactggcctgagagaatgtcaggggcatttgtaaatgtgtaaagggctgaaaaatcctgagggattattattattgctattgttgttattattcacagacacatycaacagccattgtctgcctccttatctgtcatgctttctgcacgagcgtcagcctgagcttcaatctgtgtgtatatctgcagcttacgtccttgcacccctccagaacccagtttcatccttgtaggtttttccraagcaggatttgcacaagtggcgtgttttcttaagtatttattttgcaggccatttactcggcatggctatttttacagtgggtaaggagcanggctaaaaataacttagctcataaccagacaggttctgcatttgacattacgnggnattcatttgcatcccatttggtcgcctttctggttaacnggtagaatnnaagaaagctcacccgaa

SEQ ID NO: 3711 - DNA, 1321 bp, Homo sapiens
gcgggggggaggaggagggggaggagggagcggagatctcggggctcggagccggccgccgctccgctccgatcgctgtggggcttggttttttgggggtgggggggcgggggggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagyagtttkgcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggtgagtctggacaggaccgcaggtcaccatggactgggagggctatggaggcctctactcccaactgggtcacctaccagtggggcaaactgcttcacctttctaagcctcagtttccttgtctgtagatgaggatgataattccccgttccaagacagttgtgatgattaagtgtgggtgtgtgtgtgtgcatgcatgtgtgtgtgtgtgtgtgtgtgtttgtatttataatattgccccatgcctggcttataggatatgttagactattttctctcttttccatctccttcctcaaaagaaggaaaagtccccctctatctgcctcagccctctcatctgagtgggagttyttaagatgtaaggactcctggctgacttgacttgtgtgggctaaggctacgttttctaaaacttgggagaggagggaagtggtaagggtgggcgataatcctgtctatttaaatgattaacatttttctcttgggatatcaaaatttgcatttaaatggatgttttaaatagcctgttttactctttatttgc

SEQ ID NO: 3712 - DNA, 1636 bp, Homo sapiens
  misc_feature (1624)..(1624): n equals a,t,g, or c
tcgacccacgcgtccggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccagcaaggaccccgttggacgtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgaattccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaacgcctgcacgcccagcactttaccctgcaccgctcgatctcagagctccaagccgatgtggacaccaaattgaagaggctgcacaaggctcakgaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgymctccgaatcggacgagactttcgatcagattagcaagktgkwgcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggcatgccgacctcatcaagtacgtgaaggactgcaattgccagaagctctatttagacctggacgtcatccgggagggcagagggacgccacgcgtgccctggaggagacccaggtgagcctggacgarcggnggcaagctggac

SEQ ID NO: 3713 - DNA, 645 bp, Homo sapiens
tcgacccacgcgtccgccaaaagcagacatagcttcagatgcagcttgatccagggctcagatgccatgatcagaatccaattcttgcatctgtttctttgggttggcttcattttcaggcagcccccttcctcatatcctcaagatggcagagacagcccatggtctttcccttgcagagacagatcaccaggaaacaatacctctatccctagccatgaaacagtcttgaactttattctgacttgatcagccaagtccctgttggaaccatcactgcctagcttaggcctgagacagtgctgcacctctactaccaaaggccgggctggccttccctaaagtgtatgtgctgcgtgggggagaggtacggatctgaaccaaaacgagggctgtccagcgtcagcaaatatctcccgcagtcccagtgcctccagcaggaggcaaagcatcaacccctccgtctggctcctctactgaaaattccctcagcagcctcacaggccttaggcttgtcttagctacttcttcatctacttttttgctttcttaattatttttcttttcttttttcttattttattttattttattttagatggagtttcgctccgtcgcccaggctgaagtgcagtttcagacatg

SEQ ID NO: 3714 - DNA, 729 bp, Homo sapiens
  misc_feature (725)..(725): n equals a,t,g, or c
tcgacccacgcgtccggccatttagaaataatcaactcttaatcagcctgggatagtcagtactaaaagcaccttcatgagctgtgaaaaatttaatgcatttatttacatatttagttttaaattttagtatattgttagttgaggtatagtttccaaacaaagagccgtgaaatgtttagtaactgtctctgtacctctggatgaggacagctcagccgggaatggagggggactgggtgaggagaccagaatgtcagtgtggccacgcagcacacttttgttttgtcttctgtccttgagcactggcttgttcctggataaactaggcataataatacctatcctgctgtgtgggtggaagttaaatgtgataatgatgtgtgtgagatgcctgcacagtgcctggaggtattgaagaattattgctgcctwttctttttctacctaccacttacccgctacccccgggtgctacatgttagaaaacactgtgtaaagtgtggatgcttctgaaaaatctccctgccagcagttagtgccaatagcgtgcagaaaataagatgcaatgatttggcttcttttctgtttggcaataagaagcttatttgcmcatagcctgatttctttcaatctgcaaaaaaaaaaaaaaaaaaaaaaaaaaaaaaaaaaaaaaaaaaaaaaaaaaaaaaaaaaaaaaaaaaaaaaaaaaaaaaaaaargggnggcc

SEQ ID NO: 3715 - DNA, 437 bp, Homo sapiens
  misc_feature (422)..(423): n equals a,t,g, or c
  misc_feature (427)..(427): n equals a,t,g, or c
  misc_feature (437)..(437): n equals a,t,g, or c
gaattcggcacgagggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcacaaaaagagtgcaacaaatgcttctattccatagctacggcattgctcagtaagttgaggtcaaaaataaaggaatcatacatctcaaaaaaaaaaaaaaaaaaaaaaaaaaaaaaaaaaaaaaaannaaanaaaaaaaaan

SEQ ID NO: 3716 - DNA, 1084 bp, Homo sapiens
ggatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtgggcagtgtgtgaagaaaccctgaaggtcgggcctcaagtaggtctctttctagatgcagtccgtttttggaggaraagactttcgagccacataggtgcamcaagtartaaagaaaccctggatawtctctacgcccggcaaaagattgttgtcatagcgaaagcctttggtctccaagccgtaratctggkgkacattgactttcgagatggarctkggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggctaaagggtattgaagctgcagagggatcaacttgtgcttgccagaggacgccaatgaagtttgaaacaccaacaatcagagattttgtttctgttcctcattaaatcatgagcttttgtgccgagaaaaaaaaaa

SEQ ID NO: 3717 - DNA, 1168 bp, Homo sapiens
ggcacgagcccccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgtgagagtacaatctggacaggatcagaagtagagaatgaagttgtaagagaaagggaaagacagaagaaaggctgcagtagtacaaggagaaaagcaggatgcaagaatgaggaatgaatctttgtttgaggagcatccggaaaaatataagctgtcagaaagagtaaatagaccagggacctctaaagtaaattcacacatcaaagttaaaataatgttggagaatcacctcctgtgaaaaattggcttagctttcagtatgcctctttaaacaaaacattatcattttatacaaatttttaaaatgttgttcataatatggagtttaattttaagcaccttagataatgcatttgttagcttgtttgtgaaatttttatggattttttttttcaaaattcctaattttagttggtaaggattaacttcgggaagacaggaaacccctccagtaaaattaattggttataaatggttacatattttaggcttatatacataacaaaacttctaactgaatttaaaagtgatcttgtgtaaaaacattattctagtgatattgatgtctaaatttaaaagagtgaatacacaagtaaaatatatctgctttttaaggatctattcagtttaggaaggagagtcaaaatttgtatttaatttcaatttattatattgtctgaaactgaaagtaggcctaacttttgtttgcttttgtgtatgtacaaaggcaaacatttatcaatcaactcttattaatttgagattattttgacctgattgctcagaacttttgtctatctgtatagaaatggggttttctaaatatttaaagaatttcctacgtatgtaaatttacttgcacacagtaagttaggggagacatttaatattcctcagatacctgctgttttcttgttgtgtttcttgtttttcaaataaataaactgagtgttatctgttcattaaaatagaatgtagtcag

SEQ ID NO: 3718 - DNA, 1776 bp, Homo sapiens
  misc_feature (1748)..(1748): n equals a,t,g, or c
agccactgtgcccagcctcggctcaggtttttmaatacagtcttgaccttggcattcagtatcctcacagcatggttctaattaactttctagctctatttcccttttcctgctccctctctctacaactagtctttctctgattgccccgccctcaacccatctaaactagaccccagggaagcaccttggtccccttcctctctcccactcaccatccaaccaatcaccagagcctgtacattctatattttcaacatcgattcaattgtctacttctttctagcctgccctctctgactgggactccttgagccagcctgatcaccccaatccatccctcacactgtgcccatctttctgaagtaggaatctgatcacaccamcctgctaaaaacactctggttctccccacggcatgtggtgcccttgtatagctggcaaagccttgcatggcacggccccagcctgtgcttcaactcaattgcccgactctctccagctctgctgagccacctaagtcacagatggtttctcctctcatctctgctctcttccatgtgccatttctgtggcttggaatgttcttccctcattctctttctggccctttcccgtcacaccttagacgtgcatcttcctctcgaaaacctctagtgaagcctcccagggccaggcagtaccctcctctggcttcttctggatacagaggaagaatctgagcatcgattctccatctcagcaggcctctgtgtgcctgctgactccgactagaccagagatccgtaaggacagggatcgagttttttttcttttaatkcactgcctcaaaaatcctctgtgcattacctattcatcctcttctctcccttaacctgaaccagtgatcttactgtctccatcattgtttttttcttttcttttcttttcttttttttttttgaggtggagtctggctcttcacccaggctggagtgcagtgatgcgatctcgactcactgcaacctccatctcctgggttcaagcgattctcctgcctcagcctccccagtagctgggattacaggcatgcgctaccatccccaactaatttttgcctccataattytgccttttstagaatgtcatacaggtggaattactcagtatgctgcctttttcagattggcttctttcacttagtaatatgstygttttttgagacagggtcttgctctgtcgcccaggctagagtgtggtggtgcgatcttagctcactgaaacctccacctcccaggttcaagtgaytctsctgcctcagcctcccgagtagctgggactacaggcacgtgccaccatacccggctaatttgtggatttttagtacagacggsgtttcgtcatgttggccagtgtgytgttgaattcctgacctcaagtgatccacctgcctcagcctcccaaagtgttgcgattacaggtgtgagccactgcgccaagcctcatttagtaataygcatttaaactttctccatgkctttaatggcttgatagctcatttatttttatcawggaatatttcattgtctggatggaccacagtttatttctccattcacctactgaaggacatctcggttgcttctaagttttggcaattatgaataaagctgctataaccatcaagtgcaggtttttgtgtggacctattatcaactaattcgggtaaatctcaaggagtgcaattgctggatccacagtaagagtgngtttagttttaagtgcttggccattttc

SEQ ID NO: 3719 - DNA, 784 bp, Homo sapiens
  misc_feature (1)..(1): n equals a,t,g, or c
  misc_feature (6)..(6): n equals a,t,g, or c
  misc_feature (32)..(32): n equals a,t,g, or c
ngagtntaattgctggatcacacagtaagagngtggttagttttaagtggctgtgccattttgcattcccaccagcaatgaatgagagtttctgttgctccacattctcactaccattcggtgttgtcagtgttttgcattttggccattctagtaggtgtttacatggtatctagtcatttgaatgggcatatgatgtggaacatctttttttttttattttwttattattatactttaagttttagggtacatgtgcacaaygtgcaggttwgttacatatgtatacatgtgccatgytggtgtgctgcacccaytaactcgtcatytagcattaggtatatctccyaatgctattggaacatcttttcatgtgtttatttgccatctgtatatcttccctgatgagttggggatgcattctttccatctcagagtccccagaaactaacatagcagttggtacagagttggtgctcaacaaacatcagcttaggaactatgtcctatgtttttttgtttttttttttttttaaaaaggaatgtgagctgttcccaaaacgtatgtccttcccccatgcctctaccctgcccttccacaaactttctgatcttcagcacacactacccaaccatcaaggctgagacttcccgtggccagcagtgtctcatgctggcttcaagccccacagcactgcttttttcaacttctcttgtggtttagactgtctttagcccagcaagagaattcgatatcaagcttatcgataccgtcgacctcgag

SEQ ID NO: 3720 - DNA, 699 bp, Homo sapiens
  misc_feature (12)..(12): n equals a,t,g, or c
  misc_feature (30)..(30): n equals a,t,g, or c
  misc_feature (46)..(46): n equals a,t,g, or c
  misc_feature (66)..(66): n equals a,t,g, or c
ggttcatgcttnaaccccatttgctggatnctgctttgaccctgtntccctgtactggtgttatgngaatcctggcacacattgctatcccactctgagaggmcwtgagcaaagaamccccagtrgcagaagccacattgtgctcaggtcttagttctaacaaacaccattccccattaaaaggaaccaggctccttagagaaatggatgattccagggctgtggcagggtaggtacaagatgaacctaaagtgtcgttttataccagaaagtaagaaagtattaaagtgtttaaaaaagtgatgggagcatatcacaaggattcagaagggataccaactggctaaatctggaacaatttgatcaccaaagtaagtacaataataaattctaagctattgaagtaaaggcatttattatgtgtagtaataataaatagataatgagagagaaatgaggactcatgcttacagtaaaatgccaggagctgactggcataaatgtggaaggaaggctggagtgggaaaattattattttgcaaccatcatggtaattaccagatcagataaggatcaacagatgccaaatctagggcaaatttgatgaggagcagaatatttgcactgtctttgagagtttctcccagagatcacttatttgttgtaaaaaaaaagaaaaaaaaaaaaaaaaaactcgag

SEQ ID NO: 3721 - DNA, 1257 bp, Homo sapiens
cagaaaggccttcaatttgtgtttgtcagatgttcttctgatgggttatgggctttggggaggaagacacagtgtggtgccctcctgaccacctctcatcagaggtacatgatgctggtgtaccttattactggtgatgttaaatttgggctcctggccagggttggttgctgcctcactgttcctactgaaaggtgttttttctctttttgtgcagctgttaaaaaacccgctccagcacccccgaaaccgggcaacccacctcctggccaccccgggggccagagttcttcaggaacatctcagcatccacccagtctgtcaccaaagccaaccacccgaagccctctcctccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagatgtatgacctgccatattcagtaagaactgagattggaatatttaatggtaaggaaaaggcacctgattggccaatgcatttttgctacttgatgatcatatttgtgcactcatgcctgttactaactggccaccctaaccctgcctgcttgcatccctactaatagtgcatgcactgaaggaggactggctttgttgatgcttgctgcaatgattcggaatactaagtgtgtacccagatgtggaacaggtggtcacagggctgtccttgttacttctttaatttccattcttttccatatcaggcaagcttgaggtatagtaggaagaacacacattatggagtcagacctgactgagttagaatttcagctcttggtataacataggctaggcacaacctggctgatctgtaaagtg

SEQ ID NO: 3722 - DNA, 1654 bp, Homo sapiens
gaaaggccttcaatttgtgtttgtcagatgttcttctgatgggttatgggctttggggaggaagacacagtgtggtgccctcctgaccacctctcatcagaggtacatgatgctggtgtaccttattactggtgatgttaaatttgggctcctggccagggttggttgctgcctcactgttcctactgaaaggtgttttttctctttttgtgcagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagatgtatgacctgccatattcagtaagaactgagattggaatatttaatggtaaggaaaaggcacctgattggccaatgcatttttgctacttgatgatcatatttgtgcactcatgcctgttactaactggccaccctaaccctgcctgcttgcatccctactaatagtgcatgcactgaaggaggactggctttgttgatgcttgctgcaatgattcggaatactaagtgtgtacccagatgtggaacaggtggtcacagggctgtccttgttacttctttaatttccattcttttccatatcaggcaagcttgaggtatagtaggaagaacacacattatggagtcagacctgactgagttagaatttcagctcttggtataacataggctaggcacaacctggctgatctgtaaagtggtgacatctgtctaaattgttgaagatgaaataagagaaagtccaagattattctgttagccagttacagttcttaatatacgcgcaatctcggctcactgcaagctccgcctcccaggttcaagcaattctcctgcctcagcctcctgagtacctgggattataggcgcctgccaccacatctggctattttttttatttttagtagagacggggcttcaccatgttggccaggctggtctcgaactcctgaccttaggtgatccggcctcctcagcctcccaaagtgctgggattataggtgtgagccattgtgcctggcctgctatttatcatttttatctagaagaaaaaaaaaggaattcgatatcaagcttatcgataccgtcgacctcga

SEQ ID NO: 3723 - DNA, 616 bp, Homo sapiens
  misc_feature (3)..(3): n equals a,t,g, or c
  misc_feature (592)..(592): n equals a,t,g, or c
  misc_feature (611)..(611): n equals a,t,g, or c
  misc_feature (613)..(613): n equals a,t,g, or c
agngacagcagttccctggcttctggaaggagtgtcggtctatccaaaaaatgtactaacagatatgtaaaccctgatgaatacagtatgtgttatgagaagtggcccaacgaagcagctcatccaagtgagattctgaagttgggctggcgagtacacgaatggctttcttactagagagaagtgggaccctgctaatctgtagcatgtggtggcatcatggttactcaaatatcactggaacagaaggtgaaagaagaaatctgaagagaaataaaacaaattttcggcggttccaagatggccgaataggaacagctccagtctacagctcccagtgtgagagatgcagaagatgggtgatttctgcatttccaactgagcaaacggsacaccagaagattatatcccatgcctggctgggagggtcccatgcccacggagcctcgctcattgctagcacagcagtctgagatccatctgcaaggtgggcagtawggctggsggaggggcacccaccattgctgaggcttgagtaggtaaacgaagcarycaggaagctcgaactgggtggagcccaccgcaactcaangaggcctggctacctctgnanact

SEQ ID NO: 3724 - DNA, 3546 bp, Homo sapiens
ccacgcgtccgcaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactccgagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccagggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtaaaaaaaaaaaaaaaaaaaaaaaaaaaaaaaaaaaaaaa

SEQ ID NO: 3725 - DNA, 1842 bp, Homo sapiens
  misc_feature (67)..(67): n equals a,t,g, or c
  misc_feature (98)..(98): n equals a,t,g, or c
  misc_feature (212)..(212): n equals a,t,g, or c
  misc_feature (1838)..(1838): n equals a,t,g, or c
gcgaccgcgcccttcagctagctcgctcgctcgctctgcttccctgctgccggctgcgcatggcttnggcgttggcggcgctggcggcggctcgagcngcctgcgsagccggtaccagcagttgcagaatgaagaagagtctggagaacctgaacaggctgcaggtgatgctcctccaccttacagcagcatttctgcagagagcgcacatnattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttaaaaaaaaaaaaaaaaaaaaaaaaaaaaaaaaaaaaaaaaaaaaaaaaaaaaaaaaaaaanaaaa

SEQ ID NO: 3726 - DNA, 1963 bp, Homo sapiens; identical to SEQ ID NO: 858
  misc_feature (335)..(335): n equals a,t,g, or c
  misc_feature (1959)..(1959): n equals a,t,g, or c

SEQ ID NO: 3727 - DNA, 1487 bp, Homo sapiens
  misc_feature (1470)..(1470): n equals a,t,g, or c
  misc_feature (1487)..(1487): n equals a,t,g, or c
gcgaccgcgcccctttcagctagctcgctcgctcgctctgcttccctgctgccggctgcgcatggckwtggcgttggcggcgctggcggcggtcgagccggcctgcgcagccggtaccagcagttgcagaatgaagaagagtctggagaacctgaacaggctgcaggtgatgctcctccaccttacagcagcatttctgcagagagcgcagttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcacctttaaaaaaaaaaaaaaaaaaaaaaaaaaaaaaaaaaancccgggggggggccccn

SEQ ID NO: 3728 - DNA, 1653 bp, Homo sapiens
  misc_feature (67)..(67): n equals a,t,g, or c
  misc_feature (212)..(212): n equals a,t,g, or c
  misc_feature (1636)..(1636): n equals a,t,g, or c
  misc_feature (1653)..(1653): n equals a,t,g, or c
gcgaccgcgcccttcagctagctcgctcgctcgctctgcttccctgctgccggctgcgcatggcttnggcgttggcggcgctggcggcggctcgagccgcctgcgsagccggtaccagcagttgcagaatgaagaagagtctggagaacctgaacaggctgcaggtgatgctcctccaccttacagcagcatttctgcagagagcgcacatnattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttawaaaaaaaaaaaaaaaaaaaaaaaaaaaaaaaaaaancccgggggggggccccn

SEQ ID NO: 3729 - DNA, 1830 bp, Homo sapiens
  misc_feature (67)..(67): n equals a,t,g, or c
  misc_feature (97)..(97): n equals a,t,g, or c
  misc_feature (211)..(211): n equals a,t,g, or c
  misc_feature (1813)..(1813): n equals a,t,g, or c
  misc_feature (1830)..(1830): n equals a,t,g, or c
gcgaccgcgcccttcagctagctcgctcgctcgctctgcttccctgctgccggctgcgcatggcttnggcgttggcggcgctggcggcggtcgagcngcctgcgsagccggtaccagcagttgcagaatgaagaagagtctggagaacctgaacaggctgcaggtgatgctcctccaccttacagcagcatttctgcagagagcgcacatnattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttaaaaaaaaaaaaaaaaaaaaaaaaaaaaaaaaaaaancccgggggggggccccn

SEQ ID NO: 3730 - DNA, 708 bp, Homo sapiens
  misc_feature (14)..(14): n equals a,t,g, or c
tacggacacgaggncgaaaatgagaaaggtaacaatttcgaaaaagcatgcccttctgctgtgtttccagttgtttagatgtctgctctccatgtatatatggatcacattcgtgttagatggaagttgtggaatccactgttctctcaaaccggtctctttcccttgtacctatcatagtgtacatagctcaacttcctgagtttgattctagtgttcaaagataggtatttttcatataagatgtcctgtcaaagcaagtcattgaacttacctggtatttaactgaaaacaaacaaaaatcagcaatctcttccattgcttgtagaaatactgacttaggccaggcacagtggctcacgtctaatcccagcactttgagaggccaaggcaggagtatcatttgagcccaggagttcgagaccagcctggcaacatagtgagaccttgtctctgtaaaaaggaaggaaggaagggaaggagggaggggtggagccagaggaggggaggggacactctgttatacttatcgaaaggtgctatccaggtgtggtagtgcagccgatagtctcagctactcaggaggctgaggtgggaggatcacttgagctcaggagtttgaggctgcagtgagctatgatggtaccatgtactccagcctgggcaacagagacagaccagactcctaaaaaaaaaaaaaaaaaaaaa

SEQ ID NO: 3731 - DNA, 2027 bp, Homo sapiens
  misc_feature (294)..(294): n equals a,t,g, or c
  misc_feature (1976)..(1976): n equals a,t,g, or c
  misc_feature (1981)..(1981): n equals a,t,g, or c
  misc_feature (1985)..(1985): n equals a,t,g, or c
  misc_feature (2021)..(2021): n equals a,t,g, or c
ggcacgagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccagggcccgganggggctccaaagacctgctgttctgggtcgcactggagcgcaggcgttcccactgcamcctggagaacgagcctttgcggggtttctcctggctgtcctccgaccccggcggtctcgaaagcgacacgctgcagtgggtggaggagccccaacgctcctgcaccgcgcggagatgggtacttccaggccaccggtggggtcgagcccgcagctggaaggagatgcgatgccacctgygcgccaacgctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgytgggacaaactytcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgctcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggctggagagtgatcctgaagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgataaaaaaaaaaaaaaagggcggccgcnctagngggnccaagctttacgtacgcgggcatgcgacgtcaagcncttcca

SEQ ID NO: 3732 - DNA, 699 bp, Homo sapiens
aattcggcacgagttacaggcataagccaccatgcttggtcctcattatattttaacacacccctttcattatttctaaatgctggaaagttctttattacattgagctacagttcattttgccttaatagtcacaaacttaatcctaattaaatacatacctttcccctaagttttcttatcttcaggctacagaattattgagattactctcaaccattcctcatgttagaaactctttctcaatttatttccatcctctttgtccttctctggataatctcagatttgatactgtgttttcttaaatgtggtaatcccggaactctagatatggttcttcctatttggactaatcagtatatacattccagtagatccattttgtcctttatctagatacagtatttctagtagcttgaaasycattgccttttaaaagttgttttaggattaaaaatcacaaaccaaatatccactgtcctcaagagaatcacctaacacccataaggattcttgtagactcatggtaaaggggtagctattgttttatatcagatagcaggagtagctattcttttatatcagataaaacacattaaagcaacatgaataggcatttgttaaaagraggatattccaaatagtcaacacatattaaaggaattccccaaccatccactaaatgatccaggggaa

SEQ ID NO: 3733 - DNA, 1649 bp, Homo sapiens; identical to SEQ ID NO: 437
  misc_feature (1249)..(1249): n equals a,t,g, or c

SEQ ID NO: 3734 - DNA, 1570 bp, Homo sapiens
ggatctgtgtggcatggtatgtgtgtttatgtgtattgtgggtgtctgtgtggcatgctgtgcgtgtgtgtattgtggatgtttactgtcccgggcagtagaaaggacgtcggggaagcagccccagcatcagggacaggccaggagtgcagaatgcatggaagctggtcaggtcggagcctgggatgaaggaagcacagagatgcaagggtgccagggcccatggaaccaagagccgatgatcaaggccacagtgcacacagccctggaggcaaaggacatattcatttcacaaggattaaaaagcatgggccaaggctgggccccaggccaggactggggatacagagtggatcagtccccatccctgcccccaggtgcttacccacacccattcacctcacaggtttccccaccccagccccttggcgagctcctcctcattcctcaaaacgtcgctgaggtcacgctccttcccgaggcctctccccatcctctaaaacaccctctccctgctgcccacttgcagcacagtcagagagctccgtggcctgtttccactggactgagtcttctggggggtgctggtgcagagcagagccctgggctgggagtcccggcacctcgttccactccctcacccacagcctcgctgtttaacctcaggcaggccgtgtccctcctcagcctcactttccccttgtgtaaaatgagggaagggactacgccttacatcttcagcttaaacctctttgaccttctatctggctaatggaggtgctgaccaggggcaagaagggatttgaaaaacgctttgaaaaattcatagcaggaggcaaaggagaaagagtctttattttcgtagagcgggaggcaggaggagttatggacagaggctgtcgatgaaaaggacagcatctcagagcactttgtggcatttaatgtctaatgcctcctcccattaaagcagtggcatcaaatatttaccaaagcagcattaaaaattaacctttaccatggggatgtataaaggccctaagttccctgagaagtgaccgaacatcaggagggtaaagtgacaggaaggaaggctacaagcgggttgtgaataatggaagcccccaaaggtcccccaacacagctccctgttgaccccactcccaaagccagggcagcctccggccgtgtctctgcagaggctcccagcccttcggagactcccagagggcctgcaggataaggacaggccctcagctgggcatccacagccttccatggcctggccctgcctctctgggcagctgggatctgtaggatggaaaggaatgagtctgtcggagttggaagagaccaggggaggaagtggggagtggtccgggcactggaaatagcacgtgcagaggcactgaggcagagacagctgcacatcaatccatcagaagagcagccaggtggcatgagtgtgggggaggaaggaagcgcaggaggggacaggtgggagatgcaggtaggtctgactgtgcagggccatggtaagatgtgggcttctcggtccagggacaggggtgcc

SEQ ID NO: 3735 - DNA, 774 bp, Homo sapiens
  misc_feature (618)..(618): n equals a,t,g, or c
  misc_feature (715)..(715): n equals a,t,g, or c
gtctacctccgggctgaaacgtcaccatgcctccccacagacagacggatggacagatgggcctccctgcacctgctctgtgggtgtgggggctcctgctcagcagcagtttccagacccttctccctgctttccccaagccacccgccttgaatctggggtgctctaccagacccatcccctcatttctaaagatttgagccactagtcgtgtccctctccctcagaaatgccttggtgacacttggctgctttcaactcttccacccatctgcctcttggtctcatctttaccttctgctaaaggtcctgacccccacccccgccacgccatggggcaccccatggtggtgcgtccttgggagcagctctgtccctttccccgtggcctttgccccgcctcctatgacttcgattcccacctgtccccgacccctgggaccactgaccgggcccgatcaccctgtcactgccctgtcatctgcttaccccacacggtgctctgctgacccaggtcttgctgtctcccaayagccccacgaggcttyccgtcgctcctggacactrmaggctgagcccgctgccccgccgcctccatgaggaaggcttttcctctgngagccccaggccaccctttccctcctttaagtaattacttaagtcccttgccagggccctcccagtaccctttctaaagacacccctgccccagcangctgcaggctcctgctccactttcctctcaggccctcgtcgctgtggtgctgcctttga

SEQ ID NO: 3736 - DNA, 1396 bp, Homo sapiens
  misc_feature (1187)..(1187): n equals a,t,g, or c
  misc_feature (1325)..(1325): n equals a,t,g, or c
  misc_feature (1327)..(1327): n equals a,t,g, or c
cctcgagccatgtgtccaggtggggcagatcatggagggcgcccaggtgcggtgctgaggctgagcatgcactggctggggagggtgggcagagcaggaggaaatcccttgttctccggagctggagagccagaaagagccctgcagcctgggcctcatcatcacacctcgccctcaaggcctccaggcacagcatccactgccagcctctgctcctgcctctgagggtctgtctccaaggtcttttgggggctgccccagctcccccaacacagacagcaccagagctgggcccacctgtgaggtgctgagttccccatctcagagactgtgcgagcagaggcagggaggcgcttgatgtcggatggagaaaggacaggggaggggtgtggggctcagggccccgccaggtgaaggaacaagcttggaagggtgtccttatgtctgagagttggggagacacccccaagccccagatggrcctcgaatgccaggcagggccaagctgggcccagaagtgggawggwtcccttggctgccccaggaatgcaggttccggggcaagaatccagccctggctggttgaagtccatcccaagtctccctccccacgaggctcctgcagatgccaggaatggggctggattccagattccaagcctggcsgcccagcccctatctgggaccccagcccagagcccccaggcctggcctccaacctggccccagcctcaggggagctgaattcagagaatcctgtcctaggagccagaagcgggggagggaggragggcggccctgtcctgggtgcaggcccgggggctgggggytgcccgcccgtctgggtcagccgcagctgcaaaccggccctggctgagtcatggsgcctccatctccagggcctggcttgaggtggggaatagcagtgaggttggacatccaggcacctgagggtgggcagggctccctgcggctggggtggccagtggcacctggctgttgcccccctgcaccccagccctttggcccccaagtctctgccacctccctggggttctgctcccatattcctcacacccagcacagaacccagcatgtctcctgtagacacctgcatataaaccctgactcacacacacacacacacacacacacacgcacacatgcaggccaggctcctcggccangtcaccctaccggcagagctctagacatttctggcctctggtgactattcttcaggcagctcaccctgcaagtctttattgagcacctactgtgtgccaggcagtggtacagcaagggcagaagccccacctccaagnanctgaacccctgccgtggcagagacagaaaacaaaggcagcaccacggcgacgagggctaaagagaacgc

SEQ ID NO: 3737 - DNA, 692 bp, Homo sapiens
ggcacgaggcgaatatgtgtagctcagctgttttgaaaatgatctgtttgtagaaggccacaaagcaaatattattatcttaatcttattctgaattttcaccactaaaaccacattctattgaaggaatatataataaaagtgcattatcatatagtgtcacaatgagggattcaggtgcgaagggaagactcattcctgtgaaaacatagcccatccccagcagttggtagaaggatttgctggagttcctcctctttgtgtggcctataaaacattccatgaggcatgtggcaatagtcacaatgatagtggtcttatctcctccagtcttagcatcctcactcaagccacctcttttcatagacacatactttatgtttgggaagaggtgctctaggtgggacacccctgcctgctccaaataattcctactgacatccatggcagcttcattctatctgagctggagatttgggaatttaggtgggcacagaagaaagaaggggtttggggcagtgtcgtttggatgattttgacagattcttcctgggggtaaagagagataggtgggtctaatcatccagggaataaaatgcmaaggtgtgtgtatatggaaaatccaagggagaggaaattaaaattatcccagattgcttatttaatagtcaggaaactcaactttccatgaa

SEQ ID NO: 3738 - DNA, 1654 bp, Homo sapiens
  misc_feature (872)..(872): n equals a,t,g, or c
  misc_feature (1516)..(1516): n equals a,t,g, or c
  misc_feature (1564)..(1564): n equals a,t,g, or c
caggtgacgtttacatagcgtgcagggatggctggccaccccaccctaatcttattatgcaaatgggctttccacctgactggcgcaatctgtgagccctacctaaatcaaacactgcctactcaagcctgcctataaaatccagagaactccaccagccgctctttccttttggaagcccctctttccttttggaagcccctctctctcactagagagagaacggttctcctttctctttcttttgcctattaacgtcctctcctaaattcctcatgtgtgtccgtgtcctaaatttttttggcgctagacgacgaagcccgggcacttaccccagacaacaccaccacttcaatagaatgtacaggccccgcaatcccaatcttccccaggatgtagaaacccagagcagagtgctttgggggtcccctggcggtggtaggatgtagggcatgcacagacaaatcccatccgccacacgcagctttccctttaccttgggagatgcgcttgccaggaatcctaggcttcttttgtgtcttgtttgtctgtattacagttgctccacttaatttgttgtgcatgtgttccatcttaccagactggtgcaagtgttggaaacttcagattggtaactggtgcacaccaagcctgcttcacagtagtgggtgccaaggagctgctaggcctatcctgtttcatccgagaggaaaacctcactaatccttttcctatttctaacttttttcttgcttcagtccagagaccaaaattaaaatgtaaaaggtaggattctacaagacaaatgctgktttttgtttctttgytatcatttttattattattgkcattattgktatcctataacttgncattttcaagacaacctttggagagaagggggaaaaaacacatgggctctgatcccatctcaaactggaaccacactttttgattctcagtgtagagctcattagtgctgcctgggttacttycatcagcaaaaacaactctggtctaggacttcctaaaataacagaggccagaaactcttttcctgagcttgccaaacttgtgcgtttccatgactttgaaaatacctgtgctttarcctggaacactcttcctactactcttgcctacttaaaaaattctaacttatccctcaagtctcagatgaagaagtacttgttctatgcagctcccacggattcactcagacagcaagtaccacagagtcagtatttttcaaaataatgcctgagagttccttagatcagtgagtcatgtccttccctgcacaccagctaccaccaaagccaagccaataaagcctcgtgccgaattcggcacgaggaaaaaaaccctcaaaaaatgactgaaaacttctttaaatgtgtgtttgaaagagacaaggaagctcttcgtaaaatttgktcagttaatctaactgaggcccatttaaaaatgtaccaatcagcttatatgttaaatatctaagaaactgcatttaggnttttctcaacctgaatctgcagactcaagctatycacatacaatttgnatgagcaccaagawtagcaagccatactgstctgattcatctgattttaatggaacccttgggggawtggactcaatgcagctgactggg

SEQ ID NO: 3739 - DNA, 447 bp, Homo sapiens
  misc_feature (14)..(14): n equals a,t,g, or c
  misc_feature (18)..(18): n equals a,t,g, or c
  misc_feature (435)..(435): n equals a,t,g, or c
  misc_feature (445)..(445): n equals a,t,g, or c
ctcaccagtagctntacngctctgacycwtctgattwtaatggaacccttggggattgactcaatgcagctgaytggytttttcctatattaaattgtccctaatgtgactggctacatcataatattatagactatggactatttgtcatagatgtttctatgtttgcttctctgcaaatttaagaaagttaactattttcttaaagttttgatttctaatttctcgatttgggcatacgaccaccactagcaaatgtcatcagagtacaaaaaatggaaacagaggctatcattaataatacattacttcactattgacgggatgaccgtgggttttgaagcttatgagttcaaaagtcctctttaaagtatttttcaattctgctcccgaagtgggtgaagtgtgtggtggtggccaaccaaccaattaatnggttgggttncc

SEQ ID NO: 3740 - DNA, 641 bp, Homo sapiens
  misc_feature (4)..(4): n equals a,t,g, or c
  misc_feature (11)..(11): n equals a,t,g, or c
aacnccctttnaggatttttcacctctgctcccgaagtgggtgagtgtgtgtgtgcacmcatatgtgtctgtgtgcatctgtacagaggtttcagcctggcttacatttagcacagtagcttcctttacaggagactttttgcgagcatcagtgtttcatttcacaactcaccatgtgtactaatgctaaagatacagattacagtgtaagaactggagtaattatagccttccaaatcctaaactctcaaacttccttatttcacagggcaccattagtttacttccccaaagctgatttcagcattttagcagatgttttgtgaatgttgtaaatgggtacaaaatggaggacatcctaatgttgagagtagtaaatatcattgtcatgagcctaaggcttctctatacacattagaagaaagtactctctaaagagaatggttagaagttaacagggaatacatcactattgtaataatcataaaaaagcaattgcacgccagtgttagacagtctctgggtaaccaggtgctaataattttactatattaatgaagacttcaagtcatactggtctactcatttggacagtatttgcttcagcactaggaaggctgatgtcttccttttaaactcga

SEQ ID NO: 3741 - DNA, 1397 bp, Homo sapiens
tcgacccacgcgtccgctgaattgcggccgtatgcgcggctctgtggagtgcacctggggttgggggcactgtgcccccagccccctgctcctttggactctacttctgtttgcagccccatttggcctgctgggggagaagacccgccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccakcgaacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcamaaaaaaaaaaaaaaaaaaaaaaaaaaaaaaaaaaaaaaaagggcggccgc

SEQ ID NO: 3742 - DNA, 1368 bp, Homo sapiens
ctgaattgcggccgtatgcgcggctctgtggagtgcacctggggttgggggcactgtgcccccagccccctgctcctttggactctacttctgtttgcagccccatttggcctgctgggggagaagacccgccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcaggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtttgggcttccctccagtggacggcttgtccccattagtcctgggcatcatggcagtggcctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcaaaaaaaaaaaaaaaaaaaaaaaaaaaaaaaaaaaaaaaaaa

SEQ ID NO: 3743 - DNA, 1763 bp, Homo sapiens
ccacgcgtccgattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaatttttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttttctcttgtcaatctgtcttttgttataggggccccagccaaggaacctaaagtgggtagaaggaaaaattattttttctttccctacaaactgaacatggattattagaactcaaggttttcattgacaatatagaaaagaaacactgaatcattttattttattgcccaatttttatttcttatatgactctagtgtttcatcttcataattaatcatgtttgaaggatttctgagtgactcagcagcctgttaaagaaggatgaaccaaagaaaacatttcactaaatgtgcttttaaaaatcaagtgtattgctggttctgctgcagtatgtagtcgaagaataaattagtaaattgcttctgagggtctgaaattgaataaagtaatggctttgtatttctataaaaaaaaaaaaaaaaaaaaaaaaaaaaaaaaaaaaaaaaaa

SEQ ID NO: 3744 - DNA, 1274 bp, Homo sapiens
gcccacgcgtccgctgttgctcaaaggaaataggagttggtgtgcttgtgaccaaggggttacacttmcagcttttaaaattctcctttacatgtgctcagtgttttgktttgtgttttggtttctgttttttattttaattcccacattgggcacaagaatcagaatatggatagctagtttaagaaacttttgtgggtgcactgtagcatagatgacagaatttgatgttccccccatctccaattcagttcagggcattccacagttaaacagaaatgggaacgtggggctcttataaatgaatgggcgctcacagttttggttttcagctcttcatgtctgtaagtgtgctttggggraggctatgtctgtatggtcgattctcagttatcacatttgcctctcctcccactaccttcatgamcattcagtgctgttcgcactgcagttagagagaagggacggacagttggtgacactcagccacattgctacttttatctgttctggtaagaagttagatagatggtagattgaagcaattgggtagaattagttgggggaatatttatgagttgctgtgtttgttgattagttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgmtacacataaaagtcatactgtgtgtgcacaaagagtacatggattttccagcataytgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagt

SEQ ID NO: 3745 - DNA, 847 bp, Homo sapiens
  misc_feature (20)..(20): n equals a,t,g, or c
  misc_feature (24)..(24): n equals a,t,g, or c
  misc_feature (37)..(37): n equals a,t,g, or c
  misc_feature (49)..(49): n equals a,t,g, or c
  misc_feature (96)..(96): n equals a,t,g, or c
  misc_feature (116)..(116): n equals a,t,g, or c
  misc_feature (193)..(193): n equals a,t,g, or c
  misc_feature (199)..(199): n equals a,t,g, or c
gcttaacttccaagttgggntaanttgcccaaattcnaggaccccaatnttaattgcccaaagagggagccaataccttgaagaacccaagtgttnactgcttgcagttacccgtnttaaacccggagaaccctgtgcggaatcctgaacctgcgctgtctgggtggccacacagagcccgtggtgctgccgntcatcnacagctgccagtgcagctcctgccaggggacggggtttcgccatgttgcccaggctgttcttgaactcctgggctcgagtgatccacctgcctcagcctcccaatgcgctggggttacaggcaggaaccactgcacccagccccctgacctcatcttttaagcaaggctgacattgctatgcaggcttgttgggtggacttggtgagggcacgcgtgtgaagtggctggcaggtgcctagttctgttaagcacctgccatatgataacctgaggtcccactgtgtggcagatgaaggggaaacagaggtggaaggcacccgtgccacctgggtggagcacagtggaaggcctggtgttggctctgggcgtcctcctggcaccagcctgaccactctgcctctcttactaacccatctctccctcacgtgtcccctgggaggtgacttctcaaagcgctaacaggctccgctgggtgagtccacagctgtccctcttgtgatcatgggactcagcagcactgaccacgtccttccacgctctctcacctgcccccaactgggggcccatgacttggcattagcatgttccaaataaagtgatactggcaacaaaaaaaaaaaaaaaaaaaaaactcgagggggggcccg

SEQ ID NO: 3746 - DNA, 652 bp, Homo sapiens
  misc_feature (392)..(392): n equals a,t,g, or c
aattcggcacaggggggccaccacacccggcctgtacatgctgttttgcatcttgctttatacgttggggagtgccagatgtcaccatctttcgttcttcctctggggctggtcaaatccccctgagaaaactcctctggcctcctggcggggggtgaaggccaggctgccagggccaggctgccagcttctgggagctgcaggggcagaggcagggagctgtcaggcattcagccagcaagacgcactcagtacccacttggggttcagaatccccctccctcatcttcagatgggccagatgtccccaaagccagcggcccctttctgtttcaccctgtctacagaataaacccccagtcactgggggtgggggaagagtaaggggagangggaaacgagatttggaggtctagctgctgctgaaacagccctcagttcgtctttattttgccttctgcaaaactggcctggtgttgccagctccttttgaggactttgctamcggttctcagcatccctcaattgctggcttaggattcatgggtttttaggggtggggtgggattagcatgtccagctgctttccagtttccaaagttctgtccctatcatattgcctctgatttaaaaaaaaaaaaaaaaaactcga

SEQ ID NO: 3747 - DNA, 1124 bp, Homo sapiens
gattgcctacaaatgtcagaggtataatggtttggttttcatgctggcttctcacacagtccatcacagtgattcttggagccagagggaggtatggaagactgtgtgttctccaagggaggcactgtggtctggtggataagagtgggagtcccaatcctttctccgcagatgtgctagctgtgcactctgggcaagtttctcactctcctgagcctcagcgtctttatcaatatgacgagaataaatacagcacctgcctacctcatggggttgtttcagcagtcaatgagatcatgtatatgaagcatttagtatacctagcacctaataaaagctcaacaaccagtagtcttattactaacaaaatggagctagaaggatgcattagtttaaacaaaatcttgaggcagatactgggagtacctgtctttattcttcaacttgagtctcctcccagtttgtttggataaaaactcaaatgtaatatttttaatttgggtaaaagaacttctgagaaagggttgaacatctatccacttgcctttttatgcctagggaactagagatacttgttggcggcatcgcaaatgttgctgacttatgaagtactgcagtatctgaatacctttttgtaggataatctaaagtttccaaaaaatagtatagtgttgtagtgaagaacttggactcttaagccagattattttgttcagattcagaaatcccctccactccacccactggctgtatagccttgcccaaatcactgaatctctgtgtgtctgcgtcctggtgtgtgaaatgaggacaatagtagctattgggtagggttggcctggggtctaagtgatgactgcctgtaaggtgtttagaacagtatttggtaaacaactggcactcaatcagtgttgctgtgattatgatgatttattccaaggttgcttgctttccagtacatcatagactactacttgaccaaatttactagcaatggagtacctgaaagttttacatgtgcacatttgcatgaaaaccccacaaaatttccctttgaacagtgaaggggacggcacaaagataattcttggcactaagcttaaaaaaaaaaaaaaaaaactcga

SEQ ID NO: 3748 - DNA, 660 bp, Homo sapiens
gcacgagaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattccgcaaacaacagtttttacaccagtagcaagacttcctattgttaactttgattatagcatggaggaaaagtttgaatcctttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgtccgctactggtacagagctttagctaagcaaaatatcagtgtgtgattaatctttaacttccatttgtttttgttactaattttagattaaaattatgatacattaaaaaaaaaaaaaaaaaa

SEQ ID NO: 3749 - DNA, 1424 bp, Homo sapiens
  misc_feature (1391)..(1391): n equals a,t,g, or c
  misc_feature (1406)..(1406): n equals a,t,g, or c
  misc_feature (1415)..(1415): n equals a,t,g, or c
gaattcggcacgagtggctatatatttcttcacttgcaattgcctcatggggttcttataaggctgaaatccaataacggatacaaaaatactttaaaaagtaggcatggatttctactgacagccatgagagagtttctagaactagacctggatggccccaaacaactagaaaattggacaaaagatataaaaaaaaaactgttttcaaccattggacagtagtcagcataggactcttatctttgagagaaggggcaaaaacaagatgatccctataagcttccttaatttcttttttttctttttttgagacgctgtctccaaaacaaaacaaaagaataggacaatctcgtatttcctctatctagactcaacaattcttaatatttgctttatccctgtctttctacacatgcatacacatacacacacacaggcatacataattgcatatttacagggtgtttttgctgatctatttgaaagtaagtttcagacattatgacacctactcctaattcctcatgttttttctaagaataaggatattatcttacctaacatatcttttatcaaacctacaaaaattaacaattttatatctaatattagttcatgtttaggttttgcctgttttcccccaaatgtcttttacagtacatgtttttaaaaccaggatctaaggagttcacagattatatttggttattatgtctctttagtgtcttttggcatccttgggttttctacttttatcccccatgacactgactattggaagagtccagaccaattttctatttgattgcttccytgtgtgtatcatttaatttgttcctctatctcatgtgtttcttgtaaactgaaagttaggtgtagagattgagtctaaatatttttggcaagtatatgtcgtaggtaacatttgtgctttatactgcatcatattgggagataaataatattatattgccatctctgttagtgcagccattagaaagacattgtgcctatgtctgtctctttgctgtgtttggtatctgttgagagccatatttttataaaaatcttaaagcattgtcctctgtgaagaaaatatattagaaaaattacacttgacagtataagaattgttgatttgaataaatacatgatttttagaagacatatgtatgaccagcaggaatagtagcctaataggcctttgtttgggacagaatacacttcagatcatccagaaatctaaaatcaggcctgtgtgcctttgactggtatcttccatgtggtgttgaagagtttgagaatttaaaagaaaatgaattaatactaagcaagacacacttttttctttgttccttaaaaaaaaaaaaaaaaaaractcgaggggncccttggtacccganctcaagggngcatagtcg

SEQ ID NO: 3750 - DNA, 2409 bp, Homo sapiens
ccacgcgtccgcttcgacgacgacacctgcagaagtgcggacccgccatgccgcgccacctctcgggactgctcctgctgctctggccgctgctgctgctgctgccgccgacccccgccgcccccggccccctggcccgcccgggtttgcggaggctgggcacgcggggcccagggggcagtcccgggcgccgccctggctctgctgtccccacccgcgcgccctattccggggccggccagcccggcggggcccgaggcgcaggtgtttgcaggagcaggcccttggatttggtgttcatcatcgatagttcccgcagtgtgcggcccctggagttcaccaaagtgaagacctttgtctcccagataattgacactctggacattggggcggcagatacacgggtggcagtggtgaactatgctagcaccgtgaagattgagttccatctccagacccactcagataaacagtccttgaaacaggctgtggctcggatcacacccctgtctacaggcaccatgtccggcctggctatccagacagcaatggatgaggccttcacggtggaggcaggagctcgggggcccacttccaacatccctaaggtggccatcatcgtgacagatgggaggccccaggaccaggtgaatgaggtggcggctcgggcccgggcatctggtattgaactctacgccgtgggcgtggaccgggcagacatggagtccctcaagatgatggccagcgagcccctagacgagcacgttttctatgtggagacctacggggtcattgagaaactctcctctagattccaggaaaccttttgcgctctggacccgtgtgtgcttggcacacaccggtgccagcacgtgtgtgtcagtgatggggaaggcaagcaccactgtgagtgcagccaaggctactccttgaacgccgatcagaagacgtgttcagctatcgataagtgtgctctgaacactcacggttgtgaacacatctgtgtgaacgacagaactggctcttaccactgtgagtgctacgaaggttacaccctgaaccaagacaggaagacttgttcggctcaagaccaatgtgcctttggtacacatggctgccagcacatttgtgtaaatgacagagatgggtcccatcactgtgaatgctacgagggttatactctgaatgctgacaacaaaacgtgttcagttcgcagcgagtgtgctgggggctcgcacggctgccagcacctgtgtgtggacgacgggcccgcggcctatcactgcgattgtttccccggctacaccctgaccgaagaccggaggacgtgcgcagccattgaagaagcacgaagactcgtctctacagaagatgcttgtgggtgtgaagccaccctggccttccaggagagggccagctcatatctgcagagactgaatgccaaactcgatgatattttgggcaagttgcaagcagatgcgtatggacaaatacatcgttgaattactcagatttttcacctggatatacggagagcttggtctatttaatatttttgcatacttcaatgttcctgctaataatttgccattgcaaatgctttaatattactggataagtagtatgaggatcttctagagaatcagtaggacataaacgttcacatccttaagagcaaactttagtgtctctaagctatgactgtgaaatgattcatggggaatagaatgaaaagtttggtatctctttatttaccaattgagccatttaatttttaaatgtttatattagtaagataaccattcttacaatgggaactttttatctattttctcttgatagtatttatagtataaaccagttttattattgagagtgtaaattatacaagtatttacacataaaaaagttcatataattgaggtaaatataatttagaactgtttctttaatgctttgttttttgctcactttttgctggaatatcactgaagctgtgatcaggggattataacacatatcaagatcaagtgaacactacatgaaatattgtaagaaacacataactaaagactttagttttgaattaagtgttataacttcttaccaagttttggtaaaaaatcctacattatctttactgtttcactttaggattcaatcaagaaaattatatacttataaatattgatctaaaaagttaacaacaaacccaatgtcgccattttaaagtttaagcttaacttttcttcacttacatatttagtatatgtattttatttttccgcttgaaagcttatagctcttaggagaaaaccatcctttaaattgtgactactcattttttctgtttgtattgtctttagtataataaaaagttactatctttataaaaaaaaaaaaaaaaaa

SEQ ID NO: 3751 - DNA, 876 bp, Homo sapiens
caggtaccggtccggaattcccgggtcgacccacgcgtccgcttcgacgacgacacctgcaraagtgcggacccgccatgccgcgccacctctcgggactgctcctgctgctctggccgctgctgctgctgctgccgccgacccccgccgcccccggccccctggcccgcccgggtttgcggaggctgggcacgcggggcccagggggywktcccgkkcgccgccctgkctctgctgtccccacccgcgcgccctattccggggccggccagcccggcggkgcccgaggcgcaggtgtttgcaggagcaggcccttggatttggtgttcatcatcgatagttcccgcagtgtgcggcccctggagttcaccaaagtgaagacctttgtctcccagataattgacactctggacattggggcggcagatacacgggtggcagtggtgaactatgctagcaccgtgaagattgarttccawctccagacccactcagataaacagtccttgaaacaggctgtggctcggatcacacccctgtctacaggcaccatgtccggcctggctatccagacagcaatggatgargccttcacggtggaggcaggagctcgggggcccacttycaacatccctaaggtggccatcatcgtgacagatgggaggccccaggaccaggtgaatgargtggcggctcgggcccgggcatctggtattgaactctacgccgtgggcgtggaccsggcaracatggagtcccttcaagatgaatggccagcgaagcccctagacgagcacgttttctatgtggagacctacggggtyattgagaaaccttcctytagattccaggaaacccttttgcgctcttggaacc

SEQ ID NO: 3752 - DNA, 1586 bp, Homo sapiens
tttattatactaaagmcaatacaamcagaaaaaatgagtagtcacaatttaaaggatggttttctcctaagagctataagctttcaagcggaaaaataaaatacatatactaaatatgtaagtgaagaaaagttaagcttaaactttaaaatggcgacattgggtttgttgttaactttttagatcaatatttataagtatataattttcttgattgaatcctaaagtgaaacagtaaagataatgtaggattttttaccaaaacttggtaagaagttataacacttaattcaaaactaaagtctttagttatgtgtttcttacaatatttcatgtagtgttcacttgatcttgatatgtgttataatcccctgatcacagcttcagtgatattccagcaaaaagtgagcaaaaarcaaagcattaaagaaacagttctaaattatatttacctcaattatatgaacttttttatgtgtaaatacttgtataatttacactctcaataataaaactggtttatactataaatactatcaagagaaaatagataaaaagttcccattgtaagaatggttatcttactaatataaacatttaaaaattaaatggctcaattggtaaataaagagataccaaacttttcattctattccccatgaatcatttcacagtcatagcttagagacactaaagtttgctcttaaggatgtgaacgtttatgtcctactgattctctagaagatcctcatactacttatccagtaatattaaagcatttgcaatggcaaattattagcaggaacattgaagtatgcaaaaatattaaatagaccaagctctccgtatatccaggtgaaaaatctgagtaattcaacgatgtatttgtccatacgcatctgcttgcaacttgcccaaaatatcatcgagtttggcattcagtctctgcagatatgagctggccctctcctggaaggccagggtggcttcacacccacaagcatcttctgtagagacgagtcttcgtgcttcttcaatggctgcgcacgtcctccggtcttcggtcagggtgtagccggggaaacaatcgcagygataggccgcgggcccgtcgtccacacacaggtgctggcagccgtgcgagccmmcagcacactcgctgcgaactgaacacgttttgttgtcagcattcagagtrkaassctcgtagmatwmacagtgatgggacccatctctgtcatttacacaaatgtgctggcagmcatgtgtaccaaaggcacattggtcttgagccgaacaagtcttcctgtcttggttcagggtgtaaccttcgtagcactcacagtggtaagagccagttctgtcgttcacacagatgtgttcacaaccgtgagtgttcagagcacacttatcgatagctgaacacgtcttctgatcggcgttcaaggagtagccttggctgcactcacagtggtgcttgccttccccatcactgacacmcacgtgctggcaccggtgtgtgccaarcacacacgggwccagagcgcaaaaggtttcctggaatctagaggagagtttggcaattt

SEQ ID NO: 3753 - DNA, 1011 bp, Homo sapiens
  misc_feature (2)..(2): n equals a,t,g, or c
cnccctttttttttttttttttttttttttttttttttttttttttttttttttttttttttgcagcttaaaagcattttattaagcatttttggatgttgcttcctaccacttaagaataaaaaatgcattttaataaaaacaaatctatactgaagtcattttcctttgtgagaggaaatatgaatgaaatacattcatacttaaaaacagagtattttactgccaaaactttaaatatctcaagagcataccacattttaaacacattatggtcatgtagctatttcaatattcctgggagtggtgggcaattagcctgtctatggcttaggatctgtttccatgcttgcttcctgagcttcttctacctctgagagtttttcatcattttccaatgtttgctgaagttcatggatggtactaagaagaacatgaaactgtttccgtctcaattccagcttatcttcaacactttctttaatgtgtgaaagatgctctaattcttttcccagagcctctagttcctttaatgtctcatgcctgtctggatggtgctgaatcacttttgccaaagcatcatattcttggcgattttttcgtattcgttttgcttgaagaatttgctttttgcactcagcaattttttcatgtgctccagctatgctacattctatttccttgtaaattttttcataattttccatttctctgagattcatatcatatactagtaaagttttgcccattgaaaattcacattgagacagcgtgctcagcatacgttggtactggctatatccctcttcctgggacccagagttgcaccatttaatgaaactcttcactagcagattaattctccgatcatctccagcaccatctccatcaatgaggagacgcttccgtataattcgtcgtcagtcacggctcccatggcgtgcgcggcggcggcggcgggcaagctgaggcggcggttggcggcggcggcggaggtcaaactcccacaat

SEQ ID NO: 3754 - DNA, 427 bp, Homo sapiens
  misc_feature (230)..(230): n equals a,t,g, or c
  misc_feature (290)..(290): n equals a,t,g, or c
  misc_feature (338)..(338): n equals a,t,g, or c
  misc_feature (381)..(381): n equals a,t,g, or c
tcgacccacgcgtccgcggacgcgtgggcggacgcgtgggcgcggcctcccggcgctcggctccgaccccgccgccgccaccatgcagccccccagcctgctgctgctcgtcctcgggctgctcgctgcgcccgccgccgcgctcgtccgaatcccgctgcacaagttcacctctgtgcgccggaccatgtcggagttggggggccccgtggaggatctgatcgccagangccccatttcaaaatacgcccagggggtgcccagtgtggcggggggtcccgttccggagntgctcaaggaaactacatggaacgcgcaaatactacggggaaaattcnggcatccgggaacgcccccccgcaaattgcttccacccgtccntccttttgaaaaacggggttccttcccaaccttgttgggttccccc

SEQ ID NO: 3755 - DNA, 1500 bp, Homo sapiens
  misc_feature (8)..(9): n equals a,t,g, or c
  misc_feature (417)..(417): n equals a,t,g, or c
  misc_feature (1431)..(1432): n equals a,t,g, or c
tggttttnntttttttttttgaggcccagacgactgtatttccacgttcacttcggctcctggtcactcaagaggggaaaagctcacagaaggtggcaccagcccccccctccccttcttccccaacccggcaccagcaaatgccctcctagatggggtcaagccccaggaggaccccaaaggcatcacaaggctgccttttgtccctgagtcccgacccttccaagcccttcctgcttgtccttgggcctcggcgggtcccttccacgatgggccacacgggaagacaggccagcagtgccccgctctggaccccagaccagaccccaggaggagaagcccagagaacagcctggcctggggtgggggctcagtccagaagtcctgcctgggcagccaggcccccgaagcacgggntgggggggggggggggaactacctgggccgggggagggggtcccgcgtgcaagacgatgggcggccgagccaggctggggcttcccagtcagtgacgtggctccagactcggggtcagcctagtggctgctgccccgcaccccgccctctactagacagacagacacaccaaggccggggaaaccacagaacaaaacggcagcccgacagcccggcgcctgcagagctgggctttgagtgtgagtctgagcgtgagtgtgtgcggcaggggtggccgggagggcggggcggccagcctcctcctgccggaccccgtcctccccagcgggcgggcagctagagcctggtggcctcggccaggcccacgcggttctggtcccggtcgaacacggtgtagtagcggccgatgaagacgtcccccaggatccagagcggcccgccgggcggggggatgtccatgcccatgaagccgctcaagcagatggacttcccgccctgcgacaccttgagcgtgtagtcctctgacgacagcttgtagggtttgccgcccagcgtcagggtgacctcgggcaaggtggacaccttctcacaggggatcatgtactcgccctgratcarcggcacggccccgatggccttctgcagctcgcgcacctcgtccacggggcccacgatgagcgaggtgcccgtgtccacgatggcctcgcagccccccttgcacagggtcaggctgctgcccacgtccacctgttccatgtggacctgccagtacgccttgcgggtcacgttgaggtaggacaggggacccttgtagtacttggagtctgtgccgcccagcatgagctcacccccaggctgcgcgccggggtccctgttcaggtagaaagagaagatgttcttctccaccagcttctgctgcatcaggttatcaaagwcgggaagcacattgttgaccgagatgcgggggtaggccatgcccaggatgccgtcgaacttggccgcgatgaaggtganncccggctgcttggtggcttccccgaacgtctgcctctccaccttgacgccagccaggctcgacagacc

SEQ ID NO: 3756 - DNA, 1234 bp, Homo sapiens
  misc_feature (1058)..(1058): n equals a,t,g, or c
cgccggccgcgcccacgtgaycggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcganctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccytctgcctgagcgg

SEQ ID NO: 3757 - DNA, 518 bp, Homo sapiens
  misc_feature (388)..(388): n equals a,t,g, or c
  misc_feature (414)..(414): n equals a,t,g, or c
  misc_feature (458)..(458): n equals a,t,g, or c
  misc_feature (501)..(501): n equals a,t,g, or c
tcgacccacgcgtccggcacgktcgccaggcaccgctgaccgaggcctgctgggattccagaattggagagggaggcaccatgaagactctcctgctgctggtggggctgctgctgacctgggagaatggacgggttctgggagaccagatggtctcagacactgagctccaggaaatgtccaccgaggggagtaagtacattaatcgggaaattaaaaatgctctcaagggggtgaagcagataaagacactaatagaacaaacaaacgaggagcgcaaatccctgctcaccaacttggaagaagccaagaagaagaaagaggatgccctgaatgacaccaaggattcagaaatgaagctgaaggcgtccccaggggttttcaatgncacccttgatggccctctgggaggantttaagcccttccttgaaaacagacctgtattgaagttctaagncccgagtcttccagaagccagccacaaggcttggtttggccanccaggtttgaaggagtt

SEQ ID NO: 3758 - DNA, 518 bp, Homo sapiens
  misc_feature (388)..(388): n equals a,t,g, or c
  misc_feature (414)..(414): n equals a,t,g, or c
  misc_feature (458)..(458): n equals a,t,g, or c
  misc_feature (501)..(501): n equals a,t,g, or c
tcgacccacgcgtccggcacgktcgccaggcaccgctgaccgaggcctgctgggattccagaattggagagggaggcaccatgaagactctcctgctgctggtggggctgctgctgacctgggagaatggacgggttctgggagaccagatggtctcagacactgagctccaggaaatgtccaccgaggggagtaagtacattaatcgggaaattaaaaatgctctcaagggggtgaagcagataaagacactaatagaacaaacaaacgaggagcgcaaatccctgctcascaacytggaagaagccaagaagaagaaagaggatgccctgaatgacaccaaggattcagaaatgaagctgaaggcgtccccaggggttttcaatgncacccttgatggccctctgggaggantttaagcccttccttgaaaacagacctgtattgaagttctaagncccgagtcttccagaagccagccacaaggcttggtttggccanccaggtttgaaggagtt

SEQ ID NO: 3759 - DNA, 1670 bp, Homo sapiens
ccacgcgtccggcacggtcgccaggcaccgctgaccgaggcctgctgggattccagaattggagagggaggcaccatgaagactctcctgctgctggtggggctgctgctgacctgggagaatggacgggttctgggagaccagatggtctcagacactgagctccaggaaatgtccaccgaggggagtaagtacattaatcgggaaattaaaaatgctctcaagggggtgaagcagataaagacactaatagaacaaacaaacgaggagcgcaaatccctgctcaccaacttggaagaagccaagaagaagaaagaggatgccctgaatgacaccaaggattcagaaatgaagctgaaggcgtcgcagggggtgtgcaatgacaccatgatggccctctgggaggagtgtaagccctgcctgaaacagacctgggggaagggtctacgcccgagtctgcagaagcagcacagggctggttggccaccaggttgaggagttcctgaaccagagttctcccttctacttctggattaatggcgaccgcatcgactccctgctggagaacgaccggcagcagacccacgccctggatgtcatgcaggacagtttcgaccgggcatccagcatcatggatgagctgttccaggacagattcttcacccgtgaggcccaggaccctttccacttctcacccttcagctcattccagcggaggccttttttcttcaatatcaagcaccgctttgcccggaacataatgcctttccctggctaccagcccttgaatttccacgacatgtttcagcccttcttcgacatgatacaccaggctcagcaggccatggatgttaacctgcacagactcccccactttccaatggaattcacagaagaagacaaccaggacggcgccgtgtgcaaggagatccgtcacaactccacagggtgcctgaagatgaaggaccagtgtgaaaagtgccgggagatcttgtctgtggactgttcgtccaacaaccccgctcaggtccagctgcgacaggaacttaataattccctccagattgcagagaagttcaccaagcttgtacgacgagctgctgcagtcctaccaggagaagatgttcaacacgtcctccctgctgaagcagctggacgagcagtttagctgggtgtcccagctggcgaatctcactcagactgaggacccgttctatctccaggtcacgacggtgagttcccagacttctgactccagtgctccctctggcgtcactaaggtggttgtgaagctctttgattccgaccccatcaccgtgatcctcccagaagacctctccaggaacaatcctaaatttatggagaccgtggcagagaaagcccttcaggaataccgccagaagagccgggaggagtgagatgggaacactgcctctccacatggcaggtgtctgagttctgtcgcccccgcgatgagcgataggcccctagagagagctctgcatgtcaccgagtgaccgggccttccttgaggccctcctgtcccctcaccccgcctgtcctccctctggactctgcattgtaacaccgtgttcactgatcatgggaagaactcctgtgtgccactaactcaataaaaccaccagtaatctgaaaaaaaaaaaaaaaaa

SEQ ID NO: 3760 - DNA, 606 bp, Homo sapiens
  misc_feature (591)..(591): n equals a,t,g, or c
  misc_feature (593)..(593): n equals a,t,g, or c
  misc_feature (600)..(601): n equals a,t,g, or c
  misc_feature (605)..(605): n equals a,t,g, or c
ctttttttttttttttttcagattactggtggttttattgagttagtggcacacaggagttcttcccatgatcagtgaacacggtgttacaatgcagagtccagagggaggacaggcggggtgaggggacaggagggcctcaaggaaggcccggtcactcggtgacatgcagagctctctctaggggcctatcgctcatcgcgggggcgacagaactcagacacctgccatgtggagaggcagtgttcccatctcactcctcccggctcttctggcggtattcctgaagggctttctctgccacggtctccataaatttaggattgttcctggagaggtcttctgggaggatcacggtgatggggtcggaatcaaagagcttcacaaccaccttagtgacgccagagggagcactggagtcagaagtctgggaactcaccgtcgtgacctggagatagaacgggtcctcagtctgagtgagattcgccagctgggacacccagctaaactgctcgtccagctgcttcarcaggragracgwgttgaacatcttctcctggtaggactgcagcagctcgksgtgggtgcctnanacaacannctana

SEQ ID NO: 3761 - DNA, 841 bp, Homo sapiens
  misc_feature (20)..(20): n equals a,t,g, or c
  misc_feature (29)..(29): n equals a,t,g, or c
  misc_feature (34)..(34): n equals a,t,g, or c
  misc_feature (57)..(57): n equals a,t,g, or c
  misc_feature (101)..(101): n equals a,t,g, or c
  misc_feature (703)..(703): n equals a,t,g, or c
  misc_feature (779)..(779): n equals a,t,g, or c
cttagtacgccaaaggaacnctgaatcanaagcntggacctcaccgtcgtgacctgnagatagaccgggtcctcagtctgagtgagattcgccagctgggnccacccagctaaactgcttcgtccagcttgcttcagcaggaagacgtgttgaacatcttctcctggtaggactgcagcagctcgtcgtacaagcttggtgaacttctctgcaatctggagggaattattaagttcctgtcgcagctggacctgagcggggttgttggacgaacagtccacagacaagatctcccggcacttttcacactggtccttcatcttcaggcaccctgtggagttgtgacggatctccttgcacacggcgccgtcctggttgtcttcttctgtgaattccattggaaagtgggggagtctgtgcaggttaacatccatggcctgctgagcctggtgtatcatgtcgaagaagggctgaaacatgtcgtggaaattcaagggctggtagccagggaaaggcattatgttccgggcaaagcggtgcttgatattgaagaaaaaaggcctccgctggaatgagctgaagggtgagaagtgsaaagggtcctgggcctcacgggtgaagaatctgtcctggaacagctcatccatgatgctggatgcccggtcgaaactgtcctgcatgacatccagggcgtgggtctgcnaccggtcgttctccagcagggagtcgatgcggtcgccattaatccagaagtagaagggagaactctggttcagganctcctcaacctggtggccaaccagccctgtgctgcttctgcagactcgggcgtagacccttc

SEQ ID NO: 3762 - DNA, 868 bp, Homo sapiens
  misc_feature (1)..(1): n equals a,t,g, or c
  misc_feature (23)..(23): n equals a,t,g, or c
  misc_feature (31)..(31): n equals a,t,g, or c
  misc_feature (45)..(45): n equals a,t,g, or c
  misc_feature (829)..(829): n equals a,t,g, or c
  misc_feature (860)..(860): n equals a,t,g, or c
ntttcagcagttccgcatgcccntccgtggnaagcctgttcgtgntattgggcaagaacccccatgatgcccaaggccatccaagggcatctgaagaccaacccagctctggaaaacctgttacttcatatccgggggaatgtggctttgtgttcaccaaggaggcctcacttgagatcagggacatgctgctggccaataaggtgccagctgccgcccgtgctggtgccatagccccatgtgaggtcactgtgccagcccagaacactggtctggggcccgagaagacctccttcttccaggctttaggcatcaccactaaaatctccagaggaaccattgaaatcctgagtgatgtgcagctgattaagaccggagacaaagtgggagccagtgaagccacactgctgaacatgctgaacatctcccccttctcctttgggctgatcatccagcaggtgtttgacaatggcagcatctacaaccctgaagtgcttgacatcacagaggaaactctgcattctcgcttcctggagggtgtccgcaatgttgccagcgtatgtctgcagataggttacccaactgtggcatcagtgccccattctatcatcaatggatacaagcgggtcctggctttgtctgtggagactgattacacctttccacttgctgaaaaggtcaaggccttcttggctgatccatctgcatttgtggctgctgcccctgtggccgctgccaccactgctgcacctgctgctgctgcagccccagccaaagttgaagcaaaggaagagtcggaggaawcggatgagagkattktcamttcganaatcagcaaaagcaacaattccagccagttnattgtgaa

SEQ ID NO: 3763 - DNA, 2075 bp, Homo sapiens
ccacgcgtccgtggggccgagcgccgctgggtaggcggaagtagccgcagatggcggcggctatgcccttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacaccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaacctttccacatcgaggagccccgcacaggtggcctggccaagcggctggccaaccttatccggcgcgcccgagtgtcccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggttaaaaaaaaaaaaaaaaaaaaaaaaaaaaaaaaaaaaaa

SEQ ID NO: 3764 - DNA, 1697 bp, Homo sapiens
  misc_feature (1627)..(1627): n equals a,t,g, or c
aagactccttttggcttttggagacggcagcmcgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcytcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggaccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaaaaaaaaaaaaaaaaaaaaaaaaaaaanaagggcggccgctctagaggatccctcgaggggcccaagcttacgcgtgcatgcgacgtcatagctctac

SEQ ID NO: 3765 - DNA, 2645 bp, Homo sapiens
  misc_feature (1324)..(1324): n equals a,t,g, or c
  misc_feature (2645)..(2645): n equals a,t,g, or c
tcgacccacgcgtccggtaatcttcaaatatgcgcatggcgagtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggcnttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtmaaaaaaaaaaaaaaaaaaaaaaaaaaaaaaaaaaaaaaaaaaaaaaaaaaaaaaaaaaaaaaaaaaaaaaaaaggggggggn

SEQ ID NO: 3766 - DNA, 1098 bp, Homo sapiens
  misc_feature (74)..(74): n equals a,t,g, or c
  misc_feature (346)..(346): n equals a,t,g, or c
  misc_feature (1085)..(1085): n equals a,t,g, or c
  misc_feature (1093)..(1093): n equals a,t,g, or c
  misc_feature (1095)..(1095): n equals a,t,g, or c
ggcggcccgggagggtgccccgccgccctgccccaccagtgccattggaagggccagcctgagcctccgggacnagggtcggggcctgcgcgatgcaagacgggagaaaaggaggggcgtacgcgggcaagatggaggcgactacggctggtgtgggccggctagaggaagaggcgttgcggcgaaaggaacggctgaaggccctacgggagaaaaccgggcgcaaggwsagaagtgkggagtgagggtcgcagttgaggcgtccagcgttcggggtccgggtcgcgcttgaggagagcaaagggctaataaggaaagacagctgccgagggcgcgcatgccgggncgctaacgcatgcgcgagaagacgggcgccctcccacgatgtctggggctgcttggcgtgggactcctctggcgctggtgcggtcgtcgcgcacgcgcgggggtgggcaargcagtggtcagcgacccgcagtccatctgactcctgcttcccgggtgttgctcgtgtaggtatctagggctgcctgtaggttcagatgcttgttgggttaggcgtgatttgttccgttcctctatggcctagctggtctttaacccccgccttcgattctgagtcagacagactccccagtccggcagcactccttggacagggcagcaagtgatagcagtgggtatacagccggagtcgtttcgtgcaaaaatcaaaaagaggccgggcacggtggctcacgcctgtaatcccagtgctttgggaggccgaggcaggcggatcacttgaggttagtagttcgagaccaggctgggtaacatggtgaaaccccgcctctactaaaaatacaaaaattagccgggcgtggtggtgcgcgcctgtaatcccagcttctcgggaggctatggcaggagaaccgcttgagcctgggaggtcagaggttgtagtgagtccgagatctcgccactgtactccagcctgggcaacagagcgagatccgtctcaaaaaaaaaaaaaaagggcggccgctctagaggattccctcgaggggctcaagttyacgcgtggcatgcgwmgtgcagctgtntgccctgngntgg

SEQ ID NO: 3767 - DNA, 1063 bp, Homo sapiens
  misc_feature (23)..(23): n equals a,t,g, or c
  misc_feature (27)..(27): n equals a,t,g, or c
  misc_feature (30)..(30): n equals a,t,g, or c
  misc_feature (1032)..(1032): n equals a,t,g, or c
  misc_feature (1055)..(1056): n equals a,t,g, or c
  misc_feature (1062)..(1062): n equals a,t,g, or c
gttggggggttatgccctttcgntccnttnaaatcgagtcactgatsatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttcaaaaaaaaaaaaaagggggggcccnttttaaaggatccaagtttaccnnccccgng

SEQ ID NO: 3768 - DNA, 1178 bp, Homo sapiens
  misc_feature (3)..(3): n equals a,t,g, or c
  misc_feature (41)..(41): n equals a,t,g, or c
tcnccccaataatgttctatatagcctttgctaaagagcanctaataaattaaacctattctttctgtgtgtgtgagcgtgcgtttgtgtttggtagtgttcctagggcagaggtggagcagggatgcacttatcatgggaagggaggtagaaaagagaattggatagcctgtgatctttggtggaatttattccttttgcctaggcctttcagaccctgcttgatttccgtaggacacttcaggttgtggcaagggagagctggtctgcaatcggaagtaccagcctcttccctagagcacaactagaaagaagaactatagagtgttataagggaggccctgagatggaaggaccatcacacagaaatgataataacttcatttcagggtgttccaggggaaaagcaggagaaagatttggggctcagtagaaggaaaagcttcctagtgataagagtgattggcaataccatgaggtacctttaaaagatagtgaactcctgtccttggaaatattaaaccacaggctagatatcatttaatagggatgtgaagtagagtaagtcactgcccttggtgtgcaattgtgaacttgtcaatttctgaggtccctttctacttagatatataatacaagatttctattaggtatgggtgctctgatgataatgaaaatcccagcagytatgtatgggatggttacaccagacactgtgctaaggattttctttgaattgtttctcactcaatcttcacggtagctcagtgaggtaggtaccattatcactgstagaaagcagtgaacttatatggtcttactgtggcactgggtccttaaacattatgcaaaactgtgagcaacttttatcggtttgttcttttaagaacataacacagcactctaaaaatagatctaactagattgttcacatctagcgattaaggccaccctgagattatagctgcatcatcaggracccaagatctgaagcattcagtcaaagcctcttggccacctctctttttgtcatggccttcttggacttggagggggagaatggaagcaagtaccaaggagaaagtgttctcagaaaagccacacccattagaaaaatacaaggccagtcgacgcggccgcgaattcccgggtcgacgagctcactagtcggcggccgc

SEQ ID NO: 3769 - DNA, 2522 bp, Homo sapiens
gccgctcgacaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtagcagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtaccagggaatggaatatgtagctgtggaaactgtgaatgctgggatggatggaatggaaatgcatgtgaaatctggcttggctcagaatatccttaacaattacatgagagaggtctggattcttattttttctgggccattagaacatataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcagactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgtttataaaaaaaaaaaaaaaa

SEQ ID NO: 3770 - DNA, 585 bp, Homo sapiens
  misc_feature (570)..(570): n equals a,t,g, or c
gcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctkcacaaggtgcctggtctkccaaaattggagccttcctccaatctcaaaggacaggacagctggcaratkggacaccaacaggacaagacgctctggtcttnggcttcgactggggg

SEQ ID NO: 3771 - DNA, 4344 bp, Homo sapiens
  misc_feature (754)..(754): n equals a,t,g, or c
  misc_feature (2242)..(2242): n equals a,t,g, or c
tgagaatccttgtggctttgattcggagtgtctgaacaggatgctgatgtttgagtgccacccgcagtgtgtcccgcgggcragttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgayttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgargcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggnccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcangtgtgsgtgcctcgtacgtgtgttatgggcactggtctaggccaggtatgacacccactctyctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaaaaaaaaaaaaaaaaaaaa

SEQ ID NO: 3772 - DNA, 1258 bp, Homo sapiens
aaccctcactaaagggaacaaaagctggagctccaccgcggtggcggccgctggctgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgcttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgaaaaaaaaaaaaaaaaaaaaaaaaaaaaaaaaaaaaaa

SEQ ID NO: 3773 - DNA, 2527 bp, Homo sapiens; identical to SEQ ID NO: 513

SEQ ID NO: 3774 - DNA, 1050 bp, Homo sapiens
agctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgctttttcatatttatttttgtaaatgattctgtgcccaggagcagctgggggttccacctcagggtggggcgggcaggaccccgtctccccaggtgtcggagcctgacctgaattaaagtactgactgctcgccac

SEQ ID NO: 3775 - DNA, 1642 bp, Homo sapiens
ggcgcgctgcccggarctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatcyccttagcagcagcctctgatcccttggccaagcaggagggaaccattagcagcctgaggagctggctggctgggagcctcggggaccgcccagccttgctcccagctcacccacaagatgtggacagctcttgtgctcatttggattttytccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggattcggcagcccamctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactacagcctccagtatgactgcggcctccagcactcccatgacacttgcactccccgcgcccacgtccacttycacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcktccccaagcacaaggtcccattagccaggtgtcagtggaccagcctgtggttaacacaacawataaatccacamccatgccctcaaacacaaccmcwgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcataaaaaaaaaaaaaaaaaaggg

SEQ ID NO: 3776 - DNA, 1971 bp, Homo sapiens
tgtaagaaggctcatgccattgaccctcttaattctctcctgtttggcggagctgacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttggcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgcaaaaaaaaaaaaaaaaaaaaaaaaaaaaaaaaaaa

SEQ ID NO: 3777 - DNA, 2081 bp, Homo sapiens
ttattcggaattaaccctcactaaaggcaacaaagctgggagctccaccgcggtggcggccgctctagaactagtggatcccccgggctgcagggaattcggcacgagcttgtaagaaggctcatgccattgaccctcttaattctctcctgtttggcggactggacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtcccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttggcagaccaaaattatcaaatggtgggggaattttctggtcctcttaatggatgtggtacattcagaaaggtagaaagttcagtcaattccttccaccaatataatccctttttctgcatcctcaacttctaaagtgatcacccgtcagaaacaactccagattattgtgaagtgtaatggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgcaaaaaaaaaaaaaaaaaaaaaaaaaaaaaaaaaaa

SEQ ID NO: 3778 - DNA, 2361 bp, Homo sapiens
  misc_feature (1891)..(1891): n equals a,t,g, or c
  misc_feature (2356)..(2356): n equals a,t,g, or c
ggcacgagctcgagtttttttttttttttttttctatttttgccagactcttgatactcttaaaacttgtttgtggtcagcacaacaaggaacaaaacaaagctttgaaaaaactttaacatgaaaaaacgcactgacatttttttttatttaatatagcctggactttacctgcgtatgcacatgctcagaattgtctactaggctgactatgtatcacctcttcagcttggatccaattgtggatttatttacaaacatcaaatgccttcaagccaatcctttttgctgtatgttttgcagcctactgtagtagatacgcaacagatawtgtgggaaaaaaagagataagaggaggaagctaataagagactgtcaagattgtataccttcttggtttcttttaagaatttgttgcctttctactattacagcaaagcagcattttgttactgactgcctaaaatcacttaatctcaggtgaacgcatcacttgccaaactgttggaatgctatttgtgttttgttgcactgtttttttcgtttgtttgtttgtttatttggttggctttttggagagggaaatttggaaacgggacatacacaaaagttacacacccacattccctttttatcatgacatacaagaagaaactagcagagctaagaatggagtgaagaaaggcagtatggcaggcaccagcaaagagttgagggctgttgctcttaaaaattattttttttattattattttgaaagtatggaagttttccattcactggggaaaggagggaaaagtgcatttatttttatacagagttacttaattacctccaaaacacatatgttggaaatcgcttttgctggtgcaaagtatattaatgagcaggaatacatacattgaggttatgaatagagagctcaatttgtacctttgctgtcttgctcaagcttggtatggcatgaaaactcgactttattccaaaagtaacttcaaaatttaaaatactagaacgtttgctgcgataaatcttttggatttttgtgtttttctaatgagaatactgtttttcattacctaaagaacaatttgctaaacatgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggcttttccataagtggcctttaagaaaacatggaagacaattcatgtttgacaaatgctgacagggtgaagaaagcccagtgtaaaaatgaatcgcgttttaagtgattcggttaaagagtttgggctcccgtagcaaactaatactagataataaggaaatgggggtgaaatatttttttattgttgaatcattttgtgaatgtccccctcaaaaaaagctaatggaatatttggcataaagggcatttggtggttttatttttgtttgagggggwttgtcagaaaatcccttttctctcttacgyctaactgactagggaacaattgttgatatgcatagcattgggaatacttgtcattatatactcttacaaataacacatgaagcaagaatgaccaatattctgnataattgggcactgggatcacaaaatgtgataaaactttaaatgtataaaactttatcaaataaagttttattttcccctttaaaatgtatttctttagaggcattacttttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatattctatggctgtttgtaatttctctttttttccttttttatttggtgctgaatatgtccttgtaggctctgttttaagaaaacaatatgtgggaaatgatttaatttttcctattgctcttccttgtggaaaataaagtgttttgtttttttctgttttgtaaaaaaaaaaaaaaaaaaaaaaaaaaaaaaaaaagaangagaa

SEQ ID NO: 3779 - DNA, 510 bp, Homo sapiens
gcacagactctcctggccccctgtccttttggaaagaagacagggatgaaatataatcaagcaattaaccacccccatcatcaccaagaacaacagtatcaacaagaagaacagggacaacaaaacccacggatgaaacattcctttctcagctcagatcttatctggtgcgttctctctctgctctgtcttggtgtgtggtttagagaaacatggacaacgctgtttggaagaacagggcttcccaggaatcaacaatgcccaagaaggaagggattgtagaaatagcttaaccctttcatttaccaacgtggaaattgaagcccagggaagggaagggaccggtcgtggaagggagagccatcagcagaaagagaccctgagatcttcgcctgggattcccaggaagtccagcccgagctgattcacagaataaatgcatgcaaaccttgctatcaataaattacacatgcacttacgtaaaacmcaaaaaaaaaaaaaaaaaaaaaa

SEQ ID NO: 3780 - DNA, 1739 bp, Homo sapiens
ggcacgagagatcctcaggatatctttagccaaaggaaaagctccgcattcccacctggggggaaagctggattgccatgggcacgaatagtggtgcagagtccctggccatcctgaatatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccaccaggtggaaggatgctgggcgcgtgctggagggcatcagcaaaagcatctcctacgacctagacggggaagagagctatggcaagtacctgcggcgggagtcccaccagatcgggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggaccatgggacccgactagtcggctgaaaaatgattatcttaaagtataggtggaaggatacaaatgcttagaaagagggaatcaaatcagccccgttttggaaggtgggggacagaaaatggggctacatttcccccatacctactatttttttatatcccgatttgcactttgagaatacatctaaggtcatctttcaaaagagaaaaattggacacttgagtgactttgtttttagttttgtttttgaacattatttatgtgattgttatggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcatgtaaaaaaaaaaaaaaaaaaa

SEQ ID NO: 3781 - DNA, 438 bp, Homo sapiens
  misc_feature (61)..(61): n equals a,t,g, or c
  misc_feature (351)..(351): n equals a,t,g, or c
  misc_feature (436)..(436): n equals a,t,g, or c
ggtcactcctaatgtaggatgggacgattgccccaagctctgtcgtgagtggttgattganggttttcttaagggaacaatgctgggaaagatgataggcgcccgccactgacccctcccgcctccctgcccctccagtaaactcccacacaaaatagcagtatgaggtgtggggaaataatcttggcctccgtcctgggtttacttttgactctgccacctacaagctgtcacctgaacaagtcctttccgttcctgtgtcttccctggtcacaagctctaagcctgaacccacactctgggaatgaagcagggtagcggcctctgcttcagcaactctgaggggtctancttgggtggggagttggcctcatccagaaggctgctggaaggccaagacaaggctctggtggggaagtgttctgagaagggattnct

SEQ ID NO: 3782 - DNA, 538 bp, Homo sapiens
  misc_feature (462)..(462): n equals a,t,g, or c
  misc_feature (498)..(498): n equals a,t,g, or c
  misc_feature (520)..(520): n equals a,t,g, or c
gcttgtaggtactcattgaggtttattgtgtaagatgaatgaatgttgcaaattcctaaacatgtgattcagatgcccaatcttactctgttactttatgaaaattttttaaagctatatgatgttatatcaaaatatgttgttatactttaggataatcggtgtgttagccctgaatttcagcataagtcccatttttttccatgggagtctaggaaagctatatgtttattcagcagcaaaatacagtttggaacttaaataaactattgatcaattctggtcttatgctagaaggaataaagcatcaagaaaaagaaaagattgctgtcaagaccaggaaaattgacaatagagtattagaatgcagaaatgaggggaagtggaaargccascaagtaggagagaaaaagtgcagggacagtagaaagtgaatgtaggagcttctgacccagcactcangaacgcaattcatccctaaaaagctgttgcgtctangttgccagtaaccaattaaaanccgtttgaagtagagtga

SEQ ID NO: 3783 - DNA, 1346 bp, Homo sapiens
  misc_feature (5)..(5): n equals a,t,g, or c
  misc_feature (17)..(17): n equals a,t,g, or c
  misc_feature (21)..(21): n equals a,t,g, or c
  misc_feature (36)..(36): n equals a,t,g, or c
  misc_feature (107)..(107): n equals a,t,g, or c
  misc_feature (150)..(150): n equals a,t,g, or c
  misc_feature (323)..(323): n equals a,t,g, or c
  misc_feature (1307)..(1307): n equals a,t,g, or c
  misc_feature (1337)..(1337): n equals a,t,g, or c
  misc_feature (1341)..(1341): n equals a,t,g, or c
  misc_feature (1343)..(1343): n equals a,t,g, or c
tcccntcaaggccgggnggcntgttcttggcctttncaacttttgcctttccactatttagaatgcaggtgtgtctgtcctgcaacccagcttctggctctggaaanccagctgcatcacccatgtgcctggaccttctccagaccatgnaggcccaggcgagtgactcactgccattcagtctccatctttgggcagatccaccatgagacataacttcccagaaatccagttacaaggaggaataagtattgaagacttaagaaatgcattttgcagcaggtcctcgctgtactggggcagcggtccattcatagagcccngctagaatagaggtcacaagctcagaagcttctctaaggcaggcaggaaatttaagtcgatactatgatctgcattgtgggctggaatgaacggaaggtgcctagtctaaacagctgcttgttgctcagctgttgttgccgtattgggaattcaagcctaatgatgtttggtattcccattttcaaaagaagtcaggaaatgcagatttctatgtaaatttttaaaacttctgaactgtgtatgagccatacaaaatacatttgcaggccagtcgacatcctctgatccagaatatcaatttgtgagacaagttgttggtgaggcagcattmcatagtagttaaaagcatacattttagagccagactgcccatgtccaaaccctggtcccatcactcactmccttycatttcacttctctttgcttcactttcctcatcagtaaaataaaaataatatcagtacctacctcatagggtttcatgagcattaaataaattaaaacccataaagtactttcaatgctatcaggcatttagttacatggtaaataagtgtttaaaacatttaaaacaaaagttcaaagataataarcaaggaaacagaaaacctgacaggccagctttggaaccttcttgatggcagatctatcaacatttctccctttggctgggatgaaaaggcatttgggaataaaagatcccataaaaataaatgagaagaagtgaaacaccttcattatggcaattttggtgtcagagcctaaaagacagagggatcaaaatattgcagtactaaaatctgatggtttcatgtagaaatgagatttaagcttattaaaatgtatttctttctggtgttaataacccttcacaagacctgggcaattttgaaagaaggaaagaaaatggttctccctgtggacaaraagaaacaaatgactattaaattttctaatttggagtgaactagggkgrttccccnagtttatgtgggaaggtttcagtgagggtngtangngaa

SEQ ID NO: 3784 - DNA, 912 bp, Homo sapiens
  misc_feature (36)..(36): n equals a,t,g, or c
  misc_feature (93)..(93): n equals a,t,g, or c
  misc_feature (158)..(158): n equals a,t,g, or c
  misc_feature (592)..(592): n equals a,t,g, or c
aaaatggttctccctgtggcaagaagaaccaaatgnctattaaattttctaatttggagtgaactaagttgatccctaggtttttgtgggagnccggggtgggggagtccagtggaaagcaattgctggagagtagtccttgttctttgctgacagancaggagcagagtgtggaatgaaaactcaatagcctcctctattctcaagagacaattgacttccatctgtttaaacctccccaggggaccctgctccccccatttccatttactctcctttccaccaacctagggtgacattaagaaaaccaaacccatttgaaacacaagctcttacacatcaaaagtcaggggagaagtctggttgacctgtaagccactgcatgaggcacaaagatgcaaaaaggaactttcaggaacaactgctgctccgaggactctatgtcagatataacatccgctttggcccaaaagtaggcttgagccccagaagaggaggaatgtcmagtatgtttaaaatgtgaaacctttagttatacttgctctttactcagaaaggagagagtattcccttatgccaacgaggtctctgngagttgtttgcactattggtagcaggtgctgcctggggtagctcttatggtctgtgcttgaagtgtgcaccagctgctgccctggacatgactgttggtccctgcatacaagcagccacctttaaacagatcaaatgactcttatgatgacagctgtctcactrtactttcaaactggttttaatttggttacttgcaacctaagacagcaracagcattttagggatgaattgcgttcctgaagtgcatgggtcagaaagctcmtacattcactttytactgtccctgcactttttctatcctacttgctgcccttcca

SEQ ID NO: 3785 - DNA, 995 bp, Homo sapiens
  misc_feature (12)..(12): n equals a,t,g, or c
  misc_feature (925)..(925): n equals a,t,g, or c
  misc_feature (953)..(953): n equals a,t,g, or c
agggtcaagggnagagacccaggtcctgacagcactccctgaccatgcccccatttctccccagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggackaactcctgtyttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctyccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggkatagcgtacgtacctcagcctcacacancagtgccagtgggcacacggggccgttncaacgggcaatcagaagtggcaacccatgcctgtgccacatt

SEQ ID NO: 3786 - DNA, 751 bp, Homo sapiens
  misc_feature (146)..(146): n equals a,t,g, or c
tccctcggggtccaaagtgagatgagtaccatgcggtgccggccagaggaacttcggaaggggacactctgtgactatcggcttgtgttgcctctcatgctggccagtttcatctttgacgttctctgtgctccaggtatgatgcntgaccctacagtaagtggggaactggggtaggggtagctttctctaagaaagaccaagagccccaagtttctgaatcacctttaggacccatcaggcagcttcatgggtaggtctgtgatgatgaggattttgggttcccctgtattttttcccatgcatgatacttctgtctgcctgacttaccccaacttttatacagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagaaaattagccgggcatggtggcgcgcgcctgtagtcccagctactcgggaggctgaggtgggagaattgcttgagcccaggagtttgaggctacagtgagctataatcataccactgcactccagcctgggcaacagagcgagaccctgtctcttaaaaaaaaaaaaaaaagaaaactcga

SEQ ID NO: 3787 - DNA, 1823 bp, Homo sapiens
ggcacgaggtcttgtgccaggcactgggatatggtgccgaattggatacaagggagatgggacgtcctcctgtgtgtcttgactgtcggtgtgttgccgagcattggtagcagagggggctggtttggcacccaggtaccctgcctcatccccggggccttggccagtctacacagaggaactgccctccagctgagttacccattttccatggcagggaggacagcagaaaggccgtgttccatgactaatcatagcttccatctattgagcatttactgggagctgggcactgtgctaagtgtgaaacgtgtgttgactcatttactacaacaacctggcaaggcagttcttccgttagcccctgctcaaagctaggggacctggagcacaggcggtcaagtgcttggctcaaggcacacagctcaaagtgcagatcctctgcccctcctggcatcccagtctgggggggtcaggggtgggatctctgcagtcagtgcctgggggctggatgacaagctgcagcctccccgcaaccccacgatttccatagcgcagtggagccagaaagaaacagaccattttacagaccagagaaacaaggttgctgctctctcagaccctggagccagtgacagggaaggcggagaagggacgagagcctccgtttattcggagcctgtgtataccctccttttcacaaactgtagcagcctccagaggcaggggggatctttatgatgaccaaatggggaggcttagggattggaaatcacttgcccgggagcgtgtggttggtaccactgggatttgagccttgttccgtccagctccagagcttggtgcctttcttgctcaccacgtgccggccccagctcgttgccttggcagtggaggtggtggtgtgccgaggccttcctgcaccctgggttctctggcgctgagaaataagtgcatgggcaaagtggctttgtttccaggtcagtgactgtgaccccatgtgtacacatctgtgcatctgaccgtggcattgtaacccaggggcattttctaagtgatgtgctgggggtgtgggcagggagtggggcttatggagccgacgagacaccatcagaccatagagaggctgcccaggcttgggagccatatggacctggatttgaccttgaacaggtcatttcacctgagtgtgtatagtgggaatgataacatccggctcacagaactgtggtgagaattagagatggtgggtgtcgaatgattagcacctaatcagcattttacaataaatgcaaattcttcccttctcgtagaagagtggagtctgatgagagagacagggaagtgaaaattcacagcccctggatgccagtgctgaaggagtgggttcaggactgggaacatcagaatgggcatagtgacttattctggggaagtcatgaaaagctccctggaggaggtgatgaaggggtacccaagcctggaagaggctggcagtggtactccagaaacttcatggtggcctgcaatttgtgatgcagatttttcctcactgtgagatgctggttgagacaatttcctccttggagtggcctggttttttaggggtagggggagtgcccacgtgggtgtagtttctagacagaagcagtgggaggagggcactgccaagcatgctgcttgggattatgggtgtccacagagctgcagtttctccaaaggtgttttttgtttgtttttgagacagggtcacactctgtcacccaggatggagtgcagtggcccgatcctagctcactgcaaccttgaactactaggctcga

SEQ ID NO: 3788 - DNA, 1964 bp, Homo sapiens
  misc_feature (49)..(49): n equals a,t,g, or c
ttcctttagttcgggtgtagtggggatgtacgatacattcccagaacantagccatatcgcaagtgattacctcataaggacaaactgagtcacgcggtgcgccgtctagaactagtggatcccccgkctgyaggaattcggcacgagtcttgtgccaggcactgggatatggtgccgaattggatacaagggagatgggacgtcctcctgtgtgtcttgactgtcggtgtgttgccgagcattggtagcagagggggctggtttggcacccaggtaccctgcctcatccccggggccttggccagtctacacagaggaactgccctccagctgagttacccattttccatggcagggaggacagcagaaaggccgtgttccatgactaatcatagcttccatctattgagcatttactgggagctgggcactgtgctaagtgtgaaacgtgtgttgactcatttactacaacaacctggcaaggcaggttcttccgttagcccctgctcaaagctaggggacctggagcacaggcggtcaagtgcttggctcaaggcacacagctcagaagtgcagatcctctgcccctcctggcatcccagtctgggggggtcaggggtgggatctctgcagtcagtgcctgggggctggatgacaagctgcagcctccccgcaaccccacgatttccatagcgcagtggagccagaaagaaacagaccattttacagaccagagaaacaaggttgctgctctctcagaccctggagccagtgacagggaaggcggakaagggacgagagyctccgtttattcggagcctgtgtataccctccttttcacaaactgtagcagcctccagaggcaggggggatctttatgatgaccaaatggggaggcttagggattggaaatcacttgcccgggagcgtgtggttggtaccactgggatttgagccttgttccgtccagctccagagcttggtgcctttcttgctcaccacgtgccggccccagctcgttgccttggcagtggaggtggtggtgtgccgaggccttcctgcaccctgggttctctggcgctgagaaataagtgcatgggcaaagtggctttgtttccaggtcagtgactgtgaccccatgtgtacacatctgtgcatctgaccgtggcattgtaacccaggggcattttctaagtgatgtgctgggggtgtgggcagggagtggggcttatggagccgacgagacaccatcagaccatagagaggctgcccaggcttgggagccatatggacctggatttgaccttgaacaggtcatttcacctgagtgtgtatagtgggaatgataacatccggctcacagaactgtggtgagaattagagatggtgggtgtcgaatgattagcacctaatcagcattttacaataatgcaaattcttcccttctcgtagaagagtggagtctgatgagagagacagggaagtgaaaattcacagcccctggatgccagtgctgaaggagtgggttcaggactgggaacatcagaatgggcatagtgacttattctggggaagtcatgaaaagctccctggaggaggtgatgaaggggtacccaagcctggaagaggctggcagtggtactccagaaacttcatggtggcctgcaatttgtgatgcagatttttcctcactgtgagatgctggttgagacaatttcctccttggagtggcctggttttttaggggtagggggagtgcccacgtgggtgtagtttctagacagaagcagtgggaggagggcactgccaagcatgctgcttgggattatgggtgtccacagagctgcagtttctccaaaggtgttttttgtttgtttttgagacagggtcacactctgtcacccaggatggagtgcagtggcccgatcctagctcactgcaaccttgaactactaggctcgag

SEQ ID NO: 3789 - DNA, 769 bp, Homo sapiens
  misc_feature (483)..(483): n equals a,t,g, or c
  misc_feature (667)..(667): n equals a,t,g, or c
  misc_feature (697)..(697): n equals a,t,g, or c
  misc_feature (708)..(708): n equals a,t,g, or c
  misc_feature (723)..(723): n equals a,t,g, or c
caccgcggtggcggccgctctagaactagtggatcccccgkctgyaggaattcggcacgaggtcttgtgccaggcactgggatatggtgccgaattggatacaagggagatgggacgtcctcctgtgtgtcttgactgtcggtgtgttgccgagcattggtagcagagggggctggtttggcacccaggtaccctgcctcatccccggggccttggccagtctacacagaggaactgccctccagctgagttacccattttccatggcagggaggacagcagaaaggccgtgttccatgactaatcatagcttccatctattgagcatttactgggarctgggcactgtgctaagtgkgaaacgtgtgttgactcatttactacaacaacctggcaaggcaggttcttccgttagcccctgctcaaagctaggggacctggagcacaggcggtcaagtgcttggctcaaggcacacagctcanaagtgcagatcctctgcccctcctggcatcccagtctgggggggtcaggggtgggatctctgcagtcagtgcctgggggctggatgacaaagctgcarccttcccgcamccccacgatttccatagcgcaatggagccagaaagaaacagaccattttacagaccagagaaacaagggtgctgntctcttaaaccctggagccagtgacagggnaaagccggaanaaaggaccaagaagnctccggttaattcggagcctggggaaacccttccttttacaaactg

SEQ ID NO: 3790 - DNA, 818 bp, Homo sapiens
  misc_feature (68)..(69): n equals a,t,g, or c
  misc_feature (82)..(82): n equals a,t,g, or c
ctgtgcatctgacccgtggcattttaaccccaggggccatttttctaagtgatgtgctggggttgtgnncagggagtgggcnttatggacccgacgagacaccatcagacccatagagaggctgcccaggcttgggagccatatggacctggatttgaccttgaacaggtcatttcacctgagtgtgtatagtgggaatgataacatccggctcacagaactgtggtgagaattagagatggtgggtgtcgaatgattagcacctaatcagcattttacaataatgcaaattcttcccttctcgtagaagagtggagtctgatgagagagacagggaagtgaaaattcacagcccctggatgccagtgctgaaggagtgggttcaggactgggaacatcagaatgggcatagtgacttattctggggaagtcatgaaaagctccctggaggaggtgatgaaggggtacccaagcctggaagaggctggcagtggtactccagaaacttcatggtggcctgcaatttgtgatgcagatttttcctcactgtgagatgctggttgagacaatttcctccttggagtggcctggttttttaggggtagggggagtgcccacgtgggtgtagtttctagacagaagcagtgggaggagggcactgccaagcatgctgcttgggattatgggtgtccacagagctgcagtttctccaaaggtgttttttgtttgtttttgagacagggtcacactctgtcacccaggatggagtgcagtggcccgatcctagctcactgcaaccttgaactactaggctcgag

SEQ ID NO: 3791 - DNA, 1177 bp, Homo sapiens
  misc_feature (1095)..(1095): n equals a,t,g, or c
  misc_feature (1115)..(1115): n equals a,t,g, or c
  misc_feature (1142)..(1142): n equals a,t,g, or c
  misc_feature (1162)..(1162): n equals a,t,g, or c
agccaccatgcccggcctagattaaaaatttgaagacatattctctactatgagccaatgaaattactcattttgtttctatcccatttgctgtcccttgcttttggaattttgtgtcttagtgtgactgtgattctttctctccttttgtctttcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagccygtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcrggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtcaaaaaaaaaaaaaaaaaaaaaaaaaaaaaaaaaaaraaancaaaaaaaaaaaaaaaaggnggggccgaaggttttttccctttggtnggggttatttttggcttggnattggccttcgtttt

SEQ ID NO: 3792 - DNA, 1775 bp, Homo sapiens
  misc_feature (820)..(820): n equals a,t,g, or c
gcggcgcgggtgggggttgtgcgttttacgcaggctgtggcagcgacgcggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagactgtgccaaggcctgcntaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaaaaaaaaaaaaaaaaaaaaaaaaaactcgagggggggcccgtacccaatcgccctatgatgtagtcgtattaca

SEQ ID NO: 3793 - DNA, 866 bp, Homo sapiens
  misc_feature (14)..(14): n equals a,t,g, or c
  misc_feature (27)..(27): n equals a,t,g, or c
  misc_feature (33)..(33): n equals a,t,g, or c
  misc_feature (105)..(105): n equals a,t,g, or c
cctggcttgctggncaagccttggtgnccatgntgaacaagttttgtggaagttctggggagactccaagaactaccaggaacagggatacgagtgccaggctgnatctcttgctcctctgcagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaaaaaaaaaaaaaaaaaaaaaaaaaactcgagggggggcccgtacccaatcgccctatgatgtagtcgtattaca

SEQ ID NO: 3794 - DNA, 2052 bp, Homo sapiens
  misc_feature (2045)..(2045): n equals a,t,g, or c
tttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaascgtaatgttattgaagctgtttatagtagactgaatccacatagagaaagtgatgggggtgctggagatctagaagacccatggtagccttaaaaaccttctaaaatgcttttrattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaawttttttcccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattaaaaaaaaggggggcccggtacccaattcnccctata

SEQ ID NO: 3795 - DNA, 891 bp, Homo sapiens
gaattcggcacgagccttgagctagcatttcattatgaccgtgattttyccccgcaccactttccagccttgtggtccacaattccactgggccttaagtatgtactgaactttcctgcctccctcattttgctctgcttgtgcaattttttccaccctccatctctgtcaaacgtaagccttcctgacctctaagacctacctttgtcatgtacctttaccctcaggcaaggagcaatctcttctcttcctcttctaccttgctgtagcttctccccaaggatttatcacattctgccttgaatcatagggaacagcatgtgtagtggaatgaacacaggcctctgaatccaagatacgagtttaaatcccagctttggaggtggttacttaaagtctcagtgccttcattcttctycctatataaagtagatattacaatatctaacttacagagtcattgggagctatacatgcagcgattgggtaaagcacctggcacatggcaagcgattagcaaatgctggttacttctacttctttctcttcccttttcccagtctatcataatttccttgararcaggcaccatgtcttatttacccttgtatttcccacagtacttcccatagtgarttacccttagtaaatacycagtaagttgaattgaatttaaattamctgtaagtcttaaaatgtgggattaaattaagaatatattgtcctggaaatacccaagtgtctattgatggatgaatggataaacaaaatgtggtatacacataatggaatattattcagccttaaaaaggaatgaaattctgacatgtgctacaatatgatgaacctggaagacattatatgtgaaataagccagacagaaaaggacaa

SEQ ID NO: 3796 - DNA, 501 bp, Homo sapiens
aaagtacaggttgacatccaaaatctgaaatgagaaatgctccaaaaactgaaactttttcaatgccgacacgatgctcaaagaaaatgctaattggagcatttcagattttggatttttggatttgggatgctcaactggcataatgtgaatattccaaactctgaaaaaatctgaagtctaaaacacttctggtctcaaggattttggataaaggatactcaatgtgcaacatgtagaatggtggttgcaaggtgggaggagagaatggagagttactgtttaatgatacaatgtttccgtttgggaagatggaaagttttggagatgtgtgatggttatggttgcgcaacaatgggaaggtacttagtactgcttaactgtgcacacttaaaaatggtaaaaatgataaattttgtgtatgtcttaaaacaataaaagaagttttttaaaaaaaaaaaaaaaaaaaaaactcgagggggggcccgtacccaatcgcct

SEQ ID NO: 3797 - DNA, 1340 bp, Homo sapiens
ggcacgagaaagaaaggcgagagaaaaatcaaggcaccaaatttagattggaggtctcagaggagcagtgttttccctccttcgtaacagttgaacaacttccagatgtagctagctgcaccccctgtaaagatgcaggctctttacaatgaagacacatcttctgatgttccttctctcctgtatggccagatgcacaggaatagtgcccaaaagacctcagcctgctttccctttaaggggaaggagaagaaaaaactcctttttatttttactttctttcagcattgaatttttgttgtgtgtatggtgacttctgtttttgggaaacgggaagaagccagcagcatgctgaattgtcctgacaggctccgctgggctcttgccgaggttagcagtgctttttttgtatttaaaccatctcccgggcagtgtaaaaagtttgcaggtgcggacattctgtctgactggtctcggcagtgctctataaccctgttgtgtttcttgataaaacacagccccaccctttaataaagcaaagattgctatgaaaccagagagtctattcattactgtggagtaactagagcagtctgtagtgactagacatacggcaattaggaagtcatggagttgggatttttgtcttaattttggctgctcaaagtgccccctgtaggatattcttttttcgggaattgtttccaaacttgcctgtctttatctatggtgaaactcaagccgctttttaaggcaagcctgcaaacccaagtatcaacatgggctcctgaaggcacagggagcagattcacagttctgaccagtgttagggtccccacgagggccacccatttgaactcaaggttggcagactctggccccagcacttgccgtggtttcaggatggccagcggtgacacagggctatggaaccctgggtcttcatctcttcccatatcctttgtttcaccttctttttgccatattttattgtgcttcagatagaaattttatttataagataaaaagtagctctgaggctgggcacggtggctcatgcctgtggtcccagcactttgggaggccgaggtgggtggttcacgagctcagcagatcaagaccatcctggccaatatggtgaaaccctgtctctgctaaaaatacaaaaattggctgggcgtggtggcgggtgcctgtagtcccagctactcgggaggctgaggcgggagaatcgattggacccaggaggcggaggttgcagtgagcctagatggcaccactgcgctccagcctgggtgacagagggagactgcctcaaaaaaaaaaaaaaaaaaaaaaaa

SEQ ID NO: 3798 - DNA, 813 bp, Homo sapiens
  misc_feature (338)..(338): n equals a,t,g, or c
  misc_feature (384)..(384): n equals a,t,g, or c
  misc_feature (389)..(389): n equals a,t,g, or c
  misc_feature (799)..(799): n equals a,t,g, or c
ctgcaggaattcggcacgagaaagaaaggcgagagaaaaatcaaggcaccaaatttagattggaggtctcagaggagcagtgttttccctccttcgtaacagttgaacaacttccagatgtagctagctgcaccccctgtaaagatgcaggctctttacaatgaagacacatcttctgatgttccttctctcctgtatggccagatgcacaggaatagtgcccaaaagacctcagcctgctttccctttaagggggaaggagaagaaaaaactcctttttatttttactttctttcagcattgaatttttgttgtgtgtatggtgacttctgtttttngggaaacggaagaagccagcagcatgctgaattgtcctgacaggcntccgntggctcttgccgaggttagcagtgctttttttgwatttaaaccatctcccgggcagtgtaaaaagtttgcaggtgcggacattctgtctgactggtctcggcagtgctctataaccctgttgtgtttcttgataaaacacagccccaccctttaataaagcaaagattgctatgaaaccagagagtctattcattactgtggagtaactagagcagtctgtagtgactagacatacggcaattaggaagtcatggagttgggatttttgtcttaattttggctgctcaaagtgccccctgtaggatattcttttttcgggaattgtttccaaacttgcctgtctttatctatggtgaaactcaagccgctttttaaggcaagcctgcaaacccaagtatcaacatggggncctgaagggacagg

SEQ ID NO: 3799 - DNA, 1237 bp, Homo sapiens
agcaaacccaggaaggtgtggcgtccccgcttcgcgccaagatggtgctggtgctgcgccatcctttgtgtgcccgggaaagggcgttccgggagccgggtcgggggctcctgactcgcactgggcagcatgacggtgcgccggctgtcactgctgtgccgggacctctgggcgctgtggctgctgctgaaggccggcgcagtgcgtggggcgcgggcgggtcctcgcctccccggaaggtgttgtggggcgacatgcggggacgccgggcgggggtggacgttctgggcccagccctgtcctcagaagctgctggggcagaagcccggggctgggggatgccggggatgggtgttggggtgggtgcctccgagaccagaggagccctgttccttggcagggaaggtgtgcacgggccttgcccgatggatggtttagggccatggccctggggtccctggtgagcagtggggccgcctctgcccttggcctgtgagggactgtctgtgctggtcccagaaggctgggatcacctttccactggctcctttgttcgaggtttttcatagacaggctatgtggacaaatgagggcagcgcccacgtctggctggtggaggggctgcggctcctccttggaggggacgcctggccactgctgtccccacaatggggccacccgtggtgcaaggcgtgacaagctgccctctctaggtaagcaggacttgggaggcccctggccaagcctgtggacccggctgggcggcctctgtggtctcaggtttgggtgtgtttggtctggtcagggctcaggggctgctggtccacactggccccatcctgacaattggagctttggggcaaggtccctggagaaggggtcacgtcgggaggaaacagcctgggttttgttgatgcttttctaagaatggagtactcgttttcaagagatttgtcctaattatattttccagcgggtacttatgccaagtattgatgaataattcataaaataagcatctttgtgaattttagtgaatcagaccttaactatcaacggcaatgaatgaacatctaaagtttccaattttaaagtaaagaactggctgggtacagcagttcacgcctgtaatcccagcactttgggaggccaaggctagaggatcgcttgagcccaggagtttgagatcagcctgggcaacataccaagacctcatctgttaaaaaaaaaaaaaaaa

SEQ ID NO: 3800 - DNA, 1681 bp, Homo sapiens
cgatggccccgcggccgctctagaaagtcccgttttttttttttttttttttttttttttttttagagtacgttctgcattttatttytgcaggcaacactttgctcaccagcaagaacacagcccraggaagggacccaataacctttcaaaacscaaactgctkcctgcggtgagggcccagggtcctccacggagaggacaggcatcttcctttcccaccaggaaggagtcagcccggagcctctgctatgtgcaaggcggtgtgcaagcaccggctgcggctctttgctgtctcttctttctctttggggctgggctgggtgtgcgttctggtgctgatgctttggcctgtgaggctgagcttggcayctcgacccgttcaattacagcaacgaagaagccactgctragygtggtctcaggggargcccggaggcagtgctcggcacccgggaacgtgctcaggcctcggtggggccaggcaggcagggcgggagctagcctgaaggcgcccgggttctgctgcagcgcatctcgcaccacgtcttcattctcctcctggcagagggagcacgtggagtagacgagccgctgcagggaagggaaagtgagcgcgtggcacagggctcgctgctggaaccctgccagggcatgcagacgcaccgggctaggtgtscctgccccgggmtcctccagctgtctgctcggcatacccgagccactgcaggaaggatccagcaggayrtagtggacctcaygrtagcgyggatcyragggggagaccgccaggaagtcctcctcagccagytcacagcargagacgccagcccrggccagcagcgtggccatggatgccagccgcttggcatccaggtcaaaggcaaagatcttcccttggttcttcagaagagcagccaagtgactggtcttattgcctggggcggcacaggcatcgatgacatgggagcctggcggggggtccagcagcatggctgggagacagctggccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctggaagcccgaccctgataggagaaaccttgtctcttgaaataatcaactacatcatcggagcaggtcttgagagtgttcacacgcacaaatcgaggcagctgggaggctggaccaggcctggatcccacttccaacaggtcctcattccggctcacaccccgatgaaccttgagccgagccaactcagccttgagcctcgcctggtgccggcccaacagagccttccatcggcccccaccccctcgaaagccctttcccaacaacaactcatacactagcaccttggccaggtgcggccgcagcttcttctccgcacggaggaggccggcgctggcgatcacagcatccagcacggcggagtagcgctgcgtttcgcacaccagcgcgtacagctgcttcacgttctggaagttgctggagtacaccaaccccttgatagagcctggcggctctccacgccggccaacacgcctgcagctgcagcatacagccccatgttccgtcgcgctttacggctttgtggcaaaa

SEQ ID NO: 3801 - DNA, 1934 bp, Homo sapiens
ccacgcgtccggggcgttcctggtcgtgagaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtggggcctctgatgcgggtgctcgtggtcaccatcgcccccatctactgggccctggccagagagagtggggaagccctgaatggccactctctgactgggggcaagttccggcaggagtcacacgtggagtttgctacaggggagctgctcacgatgacccagtggcccggggtctggatcccgatggcctcctgctcctcgacgtggtggtcaatggcgttgtccccggacagcctggctgacgcagatcttcaagtgcaggactttgaggagcactacgtgcaaacagggcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcggaggagaacgaggtcggctgccccgagggctttgagctggactcccagggagcgttttgtgtggatgtggacgagtgtgcgtgggatgctcacctctgccgagagggacagcgctgtgtgaacctgctcgggtcctaccgctgcctccccgactgtgggcctggcttccgggtggctgatggggccggctgtgaagatgtggacgaatgcctggaggggttggacgactgtcactacaaccagctctgcgagaacaccccaggcggtcaccgctgcagctgccccaggggttaccggatgcagggccccagcctgccctgcctagatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacagaccttgacgagtgccgcgtgaggaacctgtgtcagcacgcctgccgcaacactgagggcagctaccagtgcctgtgccccgccggctaccgtctgctccccagcgggaagaactgccaggacatcaacgagtgcgaggaggagagcatcgagtgtggacccggccagatgtgcttcaacacccgtggcagctaccagtgtgtggacacaccctgtcctgccacctaccggcagggccccagccctgggacgtgcttccggcgctgctcgcaggactgcggcacgggcggcccttctacgctgcagtaccggctgctgccgctgcccctgggcgtgcgcgcccaccacgacgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgctcatcgccgtgtccccctacccctactaaacgggagagggcattg

SEQ ID NO: 3802 - DNA, 1958 bp, Homo sapiens
ccacgcgtccggggcgttcctggtcgtgagaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtggggcctctgatgcgggtgctcgtggtcaccatcgcccccatctactgggccctggccagagagagtggggaagccctgaatggccactctctgactgggggcaagttccggcagagtcacacgtggagtttgctacagggagctgctcacgatgacccagtggcccggggtctggatcccgatggcctcctgctcctcgacgtggtggtcaatggcgttgtccccggacgagcctggctgacgcagatcttcaagtgcaggactttgaagaagcactacgtgcaaacaagggcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcggaggagaacgaggtcggctgccccgagggctttgagctggactcccagggagcgttttgtgtggatgtggacgagtgtgcgtgggatgctcacctctgccgagagggacagcgctgtgtgaacctgctcgggtcctaccgctgcctccccgactgtgggcctggcttccgggtggctgatggggccggctgtgaaaatgtggacgaatgcctggaaggggttggacgactgtcactacaaccagctctgcgagaacaccccaggcggtcaccgctgcagctgccccaggggttaccggatgcagggccccagcctgccctgcctagatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacagaccttgacgagtgccgcgtgaggaacctgtgtcagcacgcctgccgcaacactgagggcagctaccagtgcctgtgccccgccggctaccgtctgctccccagcgggaagaactgccaggacatcaacgagtgcgaggaggagagcatcgagtgtggacccggccagatgtgcttcaacacccgtggcagctaccagtgtgtggacacaccctgtcctgccacctaccggcagggccccagccctgggacgtgcttccggcgctgctcgcaggactgcggcacgggcggcccttctacgctgcagtaccggctgctgccgctgcccctgggcgtgcgcgcccaccacgacgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgctcatcgccgtgtccccctacccctactaaacgggagagggcattggcggccgctctagaggatccct

SEQ ID NO: 3803 - DNA, 1863 bp, Homo sapiens
gactaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatttttggaagatctctgaaaaaaaaaaaaaaaaaaagggcggccgc

SEQ ID NO: 3804 - DNA, 1134 bp, Homo sapiens
tccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggcatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgcattctagaaaaaggaatcattctcccctccctcccaccacatagaatcaacatatggtagggattacagtgggggcatttctttatatcacctcttaaaaacattgtttccactttaaaagtaaacacttaataaatttttggaagatctctgaaaaaaaaaaaaaaaaaaaaaaaaaaaa

SEQ ID NO: 3805 - DNA, 626 bp, Homo sapiens
gcccacgcgtccgcctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccamtgcagtggcatcttccagagccctggtcctgggatcccagaaacagcatctgttgtggctatcacagtccaagaactgtttccagcgccaattctccttctacaaggatggaaggatagtgcaaagcaggggggctctcctcagaattccagatccccacagcttcagaaa

SEQ ID NO: 3806 - DNA, 152 bp, Homo sapiens
  misc_feature (41)..(41): n equals a,t,g, or c
cagcccagcttcatggtgactgtgtttaggtctccctcgtnccgaattcctgcagcccgggggatccactagttctagagcggccgccaccgcggtrgagctccagcttttgttccctttagtgagggttaatttcgagcttggcgtaatca

SEQ ID NO: 3807 - DNA, 1760 bp, Homo sapiens
  misc_feature (1693)..(1693): n equals a,t,g, or c
  misc_feature (1748)..(1748): n equals a,t,g, or c
gggaattctccatcaccgtggtacaaaaggcagacagcgggcactaccactgcagtgcatcttccasagccctggtcctgggatcccagaaacagcatctgttgtggctatcacagtccaagaactgtttccagcgccaattctcagagctgtaccctcagctgaaccccaagcaggargccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctggctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccrgaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgcccccaagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaaatgggactttgtccyttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagtgtcgccaaacaccgactctgtcgttgccttgatcttgaacttccagcctccagaactatgagaaataaaattctgttgtttgtaagctaatccagttgtgtaatttggnatagtagcccaaatggactaggcagttggcctctggccacatgatgagttatggnatgtaaaaatac

SEQ ID NO: 3808 - DNA, 880 bp, Homo sapiens
ggcacgagactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgaggtatgtcaacacatgcctctgttggtttcaattataatgatttttttttttttgcgaagaagaagggaattttttttaataaaaaggctttgcatatcaaaaaaaaaaaaaaaaaaaaaaa

SEQ ID NO: 3809 - DNA, 1106 bp, Homo sapiens
  misc_feature (5)..(5): n equals a,t,g, or c
  misc_feature (857)..(857): n equals a,t,g, or c
  misc_feature (1037)..(1037): n equals a,t,g, or c
  misc_feature (1058)..(1058): n equals a,t,g, or c
tccancattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggnttcttttgtggaattgggtgcaaaccaggcctaccatgagttactattaactgttttgkggtatggkgtkgkccatacttcagcactcgtgaggtgtactgctgctagaatgtttgagctgttggtgaagggggtgaatgaaactctggtagctcagagggttgttcctgctcttcattnactctctccagtggaccctgnaaatctctgtcaggattgccacaatttccagcctttgggactatttat

SEQ ID NO: 3810 - DNA, 1070 bp, Homo sapiens
gaattcggcacgaggtgatacttctgaagactgcagggagaatccgttttccagcttttttcatccaccagaggccacctgtattccctatcccacaaccctagccccttcctctatctttgaagtggactatttcatcccctgtttctatcatgacagtgccttctctcatattgaccctcttgccttataagattccttgtgattacactgggtccacctgcataatcaaggctaatctctccatctggagatcttaatataatcacatctacaaagtccctttggccattgaagtaacatatttatatgtattcattattaggatgtgggacacttttgtcagggacagggatttttcagcctacctttttcttcaccttttgccaccactctcagcctgtggtctcaatgccagcctttacactgctacccccattgtctgggtagktcataccagycctcaagactagcctcaggcattgcctcttctgggaatacatcctcttacaggccaggatatgactcatgggtgcattcctaatagcacttcamttatttctactgtcaccacactgatctgtaattacttgatttgtctgactcttctgggggcttgtaagcattctggcacagagaactatgacttactggggcttacatctcttgctaaacacagtacctaaaatttagtaggcattccctcataaacatgaatgaatgaatcaaagaatgaataaacatttaggaaatgatgttgtgttggtcaacttctttcctcatcactgttaaagataaaagaatgccaagccaggttgttcagacagaagcaagcaccacatccctgagagagcagcacatctgggcagccatgtgtgagaagtcggttgcattccccatacacagttgtctttgcagctgtactcttaaccactgtaaccacagaagtggggaaacaatagggtggggtgaagtgaaaagaaaattttccaaaacttcatttatctaataaatacagatatttaaaaaaaaaaaaaaaaaactcgagggggggcccgtacccaatcgcc

SEQ ID NO: 3811 - DNA, 646 bp, Homo sapiens
  misc_feature (19)..(19): n equals a,t,g, or c
  misc_feature (544)..(544): n equals a,t,g, or c
cagatgccagggacttggncttcccccggttgaaccacaggttccaagaaacctgcagggtccagcctcccccccatccccagtyttccccaccctggcccggccctccaggtgcagaaacatgcaggcccctctccaggactgtgggaggagtgtgtccctcagactggcctgtgtcctggctcctcttaccacctcttccagaggttgtcacctgcagctgccccaggataaaggcaaggccagaraggactcctgaactcctgtgtgcctggggtggcaggggcaaacatagccaactggtggcctgagcggggccatggtgargacacccttggtggcttgtcccacatcaagctgggargtgacacttaggatgcatttttcaatattttagtgtttgaataacgggctawcttgagaaaaaaataatttgaatcacacatcacaccaaaaataaattctaggtggattttaacactttccaaaaattattattagtttagagacagggtctcactccgtcgcctaggctggagtgcangggtatgatcatggttcactgcaaccttaaactccctggcctcatatgatccccccgggctccagcccctccaaagttactgggaaactaccaaacatgccc

SEQ ID NO: 3812 - DNA, 1590 bp, Homo sapiens
tttttttttttttgtttaaatgatacaacttaattttattaggacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaacactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaaaaaaaaaaactcgag

SEQ ID NO: 3813 - DNA, 1179 bp, Homo sapiens
gggctgcaggaattcggcacgagtttaaagggtgactcgtcccacttgtgttctctctcctggtgcagagttgcaagcaagtttatcggagtatcgccatgaagttcgtcccctgcctcctgctggtgaccttgtcctgcctggggactttgggtcaggccccgaggcaaaagcaaggaagcactggggaggaattccatttccagactggagggagagattcctgcactatgcgtcccagcagcttggggcaaggtgctggagaagtctggcttcgcgttcgactgccgcaacacagaccagacctactggtgtgagtacagggggcagcccagcatgtgccaggctttcgctgctgaccccaaatcttactggaatcaagccctgcaggagctgaggcgccttcaccatgcgtgccagggggccccggtgcttaggccatccgtgtgcagggaggctggaccccaggcccatatgcagcaggtgacttccagcctcaagggcagcccagagcccaaccagcagcctgaggctgggacgccatctctgaggcccaaggccacagtgaaactcacagaagcaacacagctgggaaaggactcgatggaagagctgggaaaagccaaacccaccacccgacccacagccaaacctacccagcctggacccaggcccggagggaatgaggaagcaaagaagaaggcctgggaacattgttggaaacccttccaggccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatttcagaaaaaaaaaaaaaaaaaaactcga

SEQ ID NO: 3814 - DNA, 819 bp, Homo sapiens
gaattcggcacgaggagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagcacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgatyccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataammycacaaaaaccactgttatattaaagattacacatttcctggaaaaaaaaaaaaaaaaaactcga

SEQ ID NO: 3815 - DNA, 1448 bp, Homo sapiens
  misc_feature (1422)..(1422): n equals a,t,g, or c
  misc_feature (1434)..(1434): n equals a,t,g, or c
gaattcggcacgagcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagctgctttaccgcaagtttgtccacccgtccctgtcccgccatgagaaggagatcgacgcgtacatcgtgcaggccaaggagcgcagctacgagaccgtgctcagcttcgggaagcggggcctcaacattgccgcctccgctgctgtgcaggctgccaccaakagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaarcccctaatccgcagccagagcctgcgtgtggtcaagargaagccaccggtgcgggarggcacctcgcgctccctgaaggttcggacgargaaaaagactgtgccctcagacgtggacagctagggtctgctgcatctgcccccttcttacctcgtgccctgcakggctccagggctatttggagggaccttgggctgcacatctggcctgcctgcaccagctgcctgggcyccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggcaaaaaaaaaaaaaaaaaaaaaaaaacaaaaaaaaaaaaaaaaaaaaaaaaaaaaaaaaaaaaaaaaaaaaaaaanaaaaaaaaaaanaaaaaaaaaaaggg

SEQ ID NO: 3816 - DNA, 1868 bp, Homo sapiens
  misc_feature (1133)..(1133): n equals a,t,g, or c
  misc_feature (1136)..(1136): n equals a,t,g, or c
ggcacgagcataaattgataacattaaaagcaagcaaaactctaataataaaaggataaattgaattatggtacattctctggtgaatattgcatatcaaggaaaatgtgaaaaatgtaaatacagccgtgtaaatgaagaggaaaatgtaaagctaaacgggaaatagcgtatctatattttaggtaacatttaaatgatgataatagctaatatttttatgaaccccttactatgtgcagggtacttgttctgttttgcctacacattaattcatttaatcctcctaacaacctctgaggtatgtagtattactgccccatttttcacagctgtgctgcagtcgagtgcctgtccaagtacacactggcctgagtaggcccaggaggctgggtgatgtggctccgcagcctccactcctgtccactgtgcacactgcctctgttatattaattcatcaaatattgagggtccctttgatgccacgcactatccaccactggcaccctgacacttagaccctaacagatatggctgttgctcgtgaggatctttatttattaggaggtgatagaaagtaaaatcagataatgcatgccacgtggatcattaaaacagactgagttgcaaagagtgactccgtggttctgtgcttgkttggtcagaaaggtgtttctgagatgaagctgagcagagctgtccaaagaacaggaaagaaccagctaggctgtgattgggggatagtggtttcaggcagaaagaacagctactgggtttcctagggtgtttggagcacagccggtgaggggcacatagctgggccagggcatgtagagcttgttcagcctctggaaggcattgggattttatgctaagtatkttggaaagcctttggagggagaatggattgtgtgtggctctggctggcagcagccagttaggctttcacagtagacaaggggagatgattgtggcttgggtgacagtgtattataattacsgagaaaggkttggatatgattcagagatagggctgacagagcttgctgttggattagatgtaggaaattagcaaaggaaaggaatgggagarcagagawtgggattcaactggagccatagtagccatgtgntgnttatcagacatccaaggggaggtgccaaattgctagttggctacagggatctggcattctgtgagaggccaaggcttgggtatataggttatgtgtggataactgcatctyccwtgcttassaggccagataaaacagtgcaagaaaatattaacaataaggattatggacawtttgagtttccttctactttcctttgtgaaaatgtgttgctttaaaaatcaaaccaatgattcctttttccaagtctgataatatttgaagaatttttagagaaactaagttacaaagttatagtacttatataatcagaattggcatggtgtagagatgtcaaagtgggtgttttgctttttaatactttgtatcagggttatattttaacaaagagataagaatattagagacaggagtggtggctcacacgtgtaatcccagcactttgggatgccgaggtgggtggatcaccagaggtcaagagttcgataccagcctggccaacatggtgaaaccctgtctctactataaataccaaaattagccaggtgtggtggcgcacacctgtaatcccagctgttcagcggactgaggcacggaaatcgcttgaacctgggagctggaggttgcagtgagccaagattgtgccactgccgtccagtctgggcaacagagtgagactctgtctcaaaataataataataatagagtctagtcttcatttttgcccccccc

SEQ ID NO: 3817 - DNA, 1507 bp, Homo sapiens
  misc_feature (1047)..(1047): n equals a,t,g, or c
  misc_feature (1301)..(1301): n equals a,t,g, or c
  misc_feature (1507)..(1507): n equals a,t,g, or c
ggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgaragcgacacggacaaggaygggcggctgagcaaagcgsaaatcctgggtaattggaacatgtttgtgggcagtcaggccaccaactatggygaggacctgacccggcaccacgatgagctgtgagcmccgngcacctgccacagcctcagaggcccgcacaatgaccggaggaggggccgctgtggtctggccccctccctgtccaggccccgcaggaggcagatgcagtcccaggcatcctcctkcccctgggctctcagggaccccctgggtcggcttctgtccctgtcacacccccaaccccagggaggggctgtcatagtcccagaggataagcaatacctatttctgactgagtctcccagcccagacccagggaccctnggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccgggaaaaaaaaaaaaaaaaaaaaaaaaaaaaaaaaaaaaaaaaaaaaaaan

SEQ ID NO: 3818 - DNA, 586 bp, Homo sapiens
agagcggacgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgycacctatggccactasgsgcccgktgaagaatttcatgacgtggaggatgcagagacytacaaaaagatgctggytcgggacgagcggcgtttccgggtggccgaccaggatggggactcgatggccactcga

SEQ ID NO: 3819 - DNA, 1792 bp, Homo sapiens
ggcacgaggttgtttgagtttggtttggagcaaaactgaggtagtcctaacatttctgggactgaatccaggcaagagaaagaagaaaaagaagaagaaaaagaggaggaaaaagtggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggagaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagcttttccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaaaaaaaaaaaa

SEQ ID NO: 3820 - DNA, 1673 bp, Homo sapiens
ggcacgagagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggagaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagccagggcagcgagaagaagaaagaggacccaaggagagcacaagtcccaccaaccagagagagtcgggtgaaggtgctgagaaaactggccgccactgcaccagcttttccccaacctccctcaacccccagagccaccacgcttactcctgccccagccacaacagtgactcggtccacgtcccgggcgggaaacagatgctgcaagacctatgaccaccactggctttcccaccacgcagaggccctggaccccctcacccttcccacaggccccctacaaccactgagggtgatcactgccaggagaccctcagtttccagagaatctttaccctccattcccggaaggatcagcacagggagaggccacagacaaccaggaggcccagcaaggcccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaaaaaaaaaaaa

SEQ ID NO: 3821 - DNA, 2084 bp, Homo sapiens
  misc_feature (775)..(775): n equals a,t,g, or c
  misc_feature (2080)..(2080): n equals a,t,g, or c
  misc_feature (2083)..(2083): n equals a,t,g, or c
ggcagagggccatttcctgcaaagagccaaacccccattcctctgtgcccctcctctcccaccaagtgctttataaaaatagctcttgttaccggaaataactgttcatttttcactcctccctcctaggtcacacttttcagaaaaagaatctgcatcctggaaaccagaagaaaaatatgagacggggaatcatcgtgtgatgtgtgtsctgcctttggctgagtgtgtggagtcctgctcaggtgttaggtacagtgtgtttgatcgtggtggcttgaggggaaccgcttgttcagagctgtgactgcggctgcactgcagagaagctgcccttggctgctcgtagcgccgggccttctctcctcgtcatcatccagagcagccagtgtccgggaggcagaaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggccttctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggtgtnatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagcggggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagattaaaaaaaaaaaaaaaaaaaaaaaagggggggcngcnt

SEQ ID NO: 3822 - DNA, 988 bp, Homo sapiens
gtagcagcgtggcttccctggctcctctctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggccgggaaggaagcagacaaagcggtccaagggttccacactggggtccaccaggctgggaaggaagcagagaaacttggccaaggggtcaaccatgctgctgaccaggctggaaaggaaktggagaagcttggcccaagtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacactaaaaaaaaaaaaaaaaaaaaaaaaaaaaaaaaaaagaggagggggg

SEQ ID NO: 3823 - DNA, 1501 bp, Homo sapiens
ggcacgagcctatttctgcttactgtgttaccagagagcctgggggtctggatcctatctggccccgtcagggtggattgccaaatgagcagttctcttgccccagtccctttcctgtgctataaataagccccatgtttattttcttatgttattgaaatgagcacttgtgatttgggcctcttttgaggagtccagagagcgtccatccggtgcctggtgagggccctgcatggctggctgctgtctgaagctatttggagtcctctccctgtgttttctatgtggcttaatttcaatagaaagggttatatgcaaccctgtatctgctgattttcaggtttcaactttctgccagcgtcactgcctgcttagaagtaaagttatgtttcccataaggggataacagccacaattgaggtaattaacgaaaattgtacattggtggcagcacctcctataggatttccaatagtctttctctagtagatcattgggggctcaccttgatctcctctcttctgtctaccctgcaccaaaataccttgtcctgttttctggatatagttccaataatttttttcctaacagcctttttgtcaccagttggtttgatatcttacaacttggccaaatgagggttccattaactccatcttgtctaatgcatggagaattcaaggattttttttttcctcttttcatagcaccttccagttgccagttgtaccctggcccttctttggaagtcataatgatgaatatccattaataagagattgatgctctttcaactctcatgtcatctataccatctcagtggagaggatgactttggatgaggttggaatacaaaggaaacatttggaagtccactgcagtgtattatatgctgtgtggaagtctgggggttaggaaatacctggagggagaacttcctaagaaatgatttttggttcttttaggccttaacagcacaataaaagtatcccatgagaccattatgagcaggacacgacattgtttcacaccttgggctgtgactatttacttctcggtacagattactctggttaaatcactcagtaaagaaatcttttcatgctcacaatctgaacctgaaggctattactgaagagaattgcatctgacaacaaaatttaatttacttccagagaaaggaccagaagaaagtaaattttcatttatgtttttaagtctattgtcttaaaaagattcttttcccttaaaaaataaaaaaacctgatgtgatgggttccttcagtcaacaaatacttattgagcagttattgtgtgccagatactgttcttggtgtgaggatatggcactgaacaaaacaatgtacctactttcgtcaagcttacattctagtgaggaagataaccaaaacaagtgactgaatataatttcaaatgtcaataaatgctgtgaagaaaataaagtcagagtattatatgtaaaaaaaaaaaaaaaaaaaaa

SEQ ID NO: 3824 - DNA, 1083 bp, Homo sapiens
  misc_feature (528)..(528): n equals a,t,g, or c
  misc_feature (815)..(815): n equals a,t,g, or c
  misc_feature (876)..(876): n equals a,t,g, or c
  misc_feature (879)..(879): n equals a,t,g, or c
aaaactccccttactattgggaacaaaagctggagctccaccgcggtggcggccgctctagaactagtggatcccccgggctgcaggaattcggcacgagttgctaagttgattaaaggttggtcttccactctgccactggccacagcacaaagtgaaaacagatgtcacaagcaccttgtagatctgtcccttttttcttctgatgttcaccctccttttgagctctttctttctccaacattgcttacaaaataatctttatgcatctgagagggagcaaatattcagtaactttctgcagctgtcctcactaaagaggagaatctgttgaatgccactggaaatgtaaggatctcttgtgacagtaacatctcaaggggaaactagtggttaaattgttaattctttgagtctgaaacttttttcatttgcagtgcagataagtgcctgatcttgcagtatcacgtttctgacttctttgttctggcttcattttttttttcccaaaatgccattttcattkgntcttagagttcagaacatgtcaaagagcttctttaagcagtaggtggttttacagagcccacagagaaggaaaactaaatatcatcccggatgcagtccactacgatcgtggaggagtcagattactctccgggctttgctgwgtctgcttgtgaaacaggaaagggagactgaggcaatgagtcacctacttgggcccaaagcaccacctacgtwgaatatggagaaaatgtgaagcaaaagtttctttttatacataatcaccatttgkacataatcaccatttnctccatggttcttatccaattcagtgcatcttaaaggatggtttgtggaatcatgacatancanaaaaatccaggtactatcagtcttgcctgtttctacctaactctttcatttaaactctcactagaatctataggaactgttagcatcaattttaataagttgtcaactaagtgattagtggtatttattggttatttttgacaaaataatggaatcatcaaattttgaagttgaaaagtaaagtaaaaatttgtgccaaacccc

SEQ ID NO: 3825 - DNA, 1904 bp, Homo sapiens
  misc_feature (46)..(46): n equals a,t,g, or c
  misc_feature (63)..(63): n equals a,t,g, or c
  misc_feature (88)..(88): n equals a,t,g, or c
  misc_feature (102)..(102): n equals a,t,g, or c
  misc_feature (1895)..(1896): n equals a,t,g, or c
  misc_feature (1900)..(1900): n equals a,t,g, or c
  misc_feature (1902)..(1903): n equals a,t,g, or c
ggttgtgttcgccaggtgcgtcacttgcaaggcctaggccgtcttngcttctccttccttctngcacgttgcggcttcccgtcaagtntaatcggggctccnttagggtccgatttaggctttcggcacttcgccccaaaaacttgattagggtgatggttcacgtagtgggccatcgccctgatagcggtttttcgccctttgacgttgaagtccacgttctttaatagtggactcttgttccaaactggaccaacactcaaccctatctcggtctattcttttgatttataagggattttgccgatttcggcctattggttaaaaaatgagctgatttaacaaaaatttaacgcgaattttaacaaaatattaacgcttacaatttgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgkktaccgggccccccctcgagtttttttttttttttttttgcaaatcatgaccaatacttttaatcctaaagctaagtgtgagaagggctgaaaaactgttaagattttttataacctttctaactgggttggccacatggagcagaaaatcatggactttagagtctgacaaacctgggttcaaaattcagttttattactttctagcttgtgtatctgtgcaagtcactttaattttctgagacttgttttcttcatttatacaactgtcaataaaatatgtttttaaaggtgtattttgaggtctctagaacaatgccaggcttggtaggcatttaataagtactggctaagaatattaamcaggattgtgtttaaatactcccattcatattacctacattgtgaaacactgtcaaaatggtatataccagaataaaatgtgaattgtattttttgaccattctttcttaaatacataaggagagctgctatctctagcccattttgtgggaaagagtcagtgcaatggagggtggttcactatgatccctaagaattgaccccactgacagcaccctctttgacttttccctgctaacttcagcaggtagcaagaggggagcatgggctatggtgtcagattaattgaggctccatcaaccacccagatggaattttaggagctatggtaattcctatctgctgggtagggttcctgaaatacaaccatggtgtttcatytyctagttgttgctgtcgtctttctgagttgctctgtgatccaccatattccttctctaatcttgctttgatttatgaatgtacatgatgatggtgatggtaatatcctaatttaaatgataaatactcgaactaacttggcccagagaaccctaccaaaaaaaggaatcaatgagtcagatccttagaaaacagttcctagagtcattctagctaatcttttcatcagttgagagttttgcaaaggggtttctgcctcattgaccaagaaagtgtagcggcttaccaatgccaacctcttaaagcataagtagaggaaatcaatggtaacctgctaacctcagttctacgcaatgcattggcagtttgggacagcattaatgtttataatatgaccttgtctacatttggggtttggcacaaatttttactttacttctcaacttcaaaatttgatgattccattattttgtcaaaaataaccaataaataccactaatcacttagttgacaacttattaaaattgatgctaacagttcctataggtaaagtagaggagaatttagtaanngtangnnt

SEQ ID NO: 3826 - DNA, 720 bp, Homo sapiens
ggcacgagatttctcacaatgacaaattctcaaatattgctaatagtactgtggattttcctacattggtaaattgaaggaattgctaaatgctgaattcagcaaccagtttgagattgttgaaaataaagattgtttctttttcaatgcaagttcacagatcactggagttctagctacagtttgttctagaccagaggttgcagatatttttgtcctataaagagacacatggttaatatttttggctttgtgagttgtatagttttcgttgtagctgttcagctctgctacatgaagcaaccatagaccataccttaacaagtggtcacttttgagtaccaataaaactttatttagaaataacagagggctggatttggtcctagtttgctgaacccttttctagatgaaggctcctcttgccaagactggctccctaccttggctgacaaattctcactttgggacttagtcattgttgctgctctctgttattttgcatgtcttttctcatgtttaggtgctgtgtcttaatacttttttcttacatttaatttaacaatcattactgagcgctggtatgtctagtttcttttctcttctttcctccttttcttttctttttttctttttctttatttgaaggctctcactctgtcactccagcctgggtggcagaccaggaccctgtctctaaaaaaaaaaaaaaaaaaaaaa

SEQ ID NO: 3827 - DNA, 1937 bp, Homo sapiens
  misc_feature (1)..(1): n equals a,t,g, or c
  misc_feature (11)..(11): n equals a,t,g, or c
  misc_feature (23)..(23): n equals a,t,g, or c
  misc_feature (1626)..(1626): n equals a,t,g, or c
  misc_feature (1884)..(1884): n equals a,t,g, or c
  misc_feature (1908)..(1908): n equals a,t,g, or c
  misc_feature (1916)..(1916): n equals a,t,g, or c
nacggaacccnctaaattgaatnaaagctgcagctccaccgcggtggcggccgctctagaactagtggatcccccgggctgcaggaattcggcacgagcagcatcagcagtgtgatggtacaccaagaaggggctgttgatataaatttttttaaaatattggtatagttaaatacttatattttaaaatattggtgtgttttttggtgctataaattactaacttgtgtgttcctaaaatcaagttgaaactaggataattgtctagttcttgctttgataagaacgcagtagttctgatgcttgtgtccatgtgtatgggtctgttattcttgcaagtgggtaagcaatgcatagcttttttttatactgagagcactagaaggccaaagcatctcaaaaccatgggttctgggtatgcataatttttggaaaggcacgataagcaaatctcacagtctggctggtcagcagctgcagggataaggagactaattgccaaggccatgcaaatgcaaagaggaaggtgaggaggattcccagatgtgatcatagcttgcaaagatggtcatctcatggggccagaattcgtgcatgcccacacctacaaagctgagaactggtagtggtcatgtgtccgcttcaagcaatgcatgtattcacagccgscagcatcaagaggggccatcttttgataggatgacacatgcatgktcaaacatattttaaaagattagggagaaaagaatactgtgaacaaatagaamccaattatgagcaaattcacgaattcggstatgtactattgwggctggcaaaasccacttaaactaggctctctagcctgattttcagccatcattacccctcactaagaatccttgtaaaatttcttccgtaaaagttaattacactcatcaccactgtttgctaatgggagcaaacccctagccaatattttttagaataatatggttgggataactttttttttttttttttgctaaatgaatgcatgattatcttatacaataaaagtataacacaaaatactgttttaagatagtcgctgggactctccttacccttgaagtgtccccctttccctcctccacatccagtcaaccgcaggttcctcccaggtttactatctgacatgttttagctctcttccttcttttccattcctctacaacttctctagttctggctttcattgtttctcaaccaaaacagtctccccttctctctcctccattcttgcgtccttccaaaacatcctctccaccctgccagagcagctcaccttagtcacagtctgactgcaactgcatgtgcttatcaatcctctcatttctcctcatcacctataacagtgcttttgacgctgcaacttgtgagccatttcgcgggttagaaaataagtttcatgggttgtaaccagtagtttaaaaaaaaaaaaaaaaaactcgagggggggcccggtayccaattcgccctatagtgagtcgtattacaattcactggccgtcgttttacaacgtcgtgactgggaaaaccctggcgttacccaacttaatcgccttgcagcacatccccctttcgccagctggcgtaatagcgaanaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagttttggaacaagagtccactattaaagaacgtggactccaacgtcaaagggcgaaaaaccgtntatcagggcgaaggcccactacgnggaccatnaccctaatcaagtttttgggg

SEQ ID NO: 3828 - DNA, 2460 bp, Homo sapiens
  misc_feature (172)..(172): n equals a,t,g, or c
  misc_feature (2457)..(2457): n equals a,t,g, or c
  misc_feature (2459)..(2460): n equals a,t,g, or c
ggatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcancaacgggcaaccccgtagaagtcggtcggcaggtcctctccaacccgccgctaccgcgccgctgtgggagagaccccagcaggagcccaarggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagaaaaaaaaaaaaaaaaaaaaaaaggggggggngnn

SEQ ID NO: 3829 - DNA, 1163 bp, Homo sapiens
ggcacgagctggctgcagggtctctggggagagaaggggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcgaaaaaaaaaaaaaaaaaa

SEQ ID NO: 3830 - DNA, 1183 bp, Homo sapiens
tgcaggaattcggcacgagctggctgcagggtctctggggagagaaggggcctcggcttcacaggatggggctgccagtgtcctgggcccctcctgccctctgggttctagggtgctgcgccctgctcctctcgctgtgggcgctgtgcacagcctgccgcagcccgaggacgctgtagcccccaggaagagggcgcggaggcagcgggcgaggctgcagggcagtgcgacggcggcggaagcgtccctactgaggcggacccacctctgcttccctcagcaagtcggacaccagactgcacgagctgcaccggggcccgcgcagcagcagggccctgcggcctgccagyatggatctcctgcgcccacactggctggaggtgtccagggacatcaccggaccgcaggcagccccctctgccttcccacaccaggagctgccccgggctctgccggcagctgcagccaccgcaggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcgaaaaaaaaaaaaaaaaaagggcggccgc

SEQ ID NO: 3831 - DNA, 1938 bp, Homo sapiens
  misc_feature (1296)..(1296): n equals a,t,g, or c
gcacacttctggctgctggtcttcatgcctctcttcttcgtgtcccccgtgtccgtggctgcctgcgtctggggctttcracacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaawtttcccatttttaagagaatatgggaacatttcatatgatctccatcacgaagatagtgaagatgctgaagaamcatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtgatgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgnaatattttagcagtgtaatatgttgaattctagttctctgcattaccattattacgttaaagtattttttaaagcttargtgtgaagatatgtgkctattgcagatgtccttggaaaactgcataaaacagtatgtgccyggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttytccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttcaaattatctttgtagataagaacagtgkttcttttttcttttcttttgkttttttgkttgkttgktttgktttgttttgagacagagtttcactctt

SEQ ID NO: 3832 - DNA, 768 bp, Homo sapiens
  misc_feature (7)..(7): n equals a,t,g, or c
  misc_feature (707)..(707): n equals a,t,g, or c
  misc_feature (726)..(726): n equals a,t,g, or c
  misc_feature (743)..(743): n equals a,t,g, or c
tgcctgnagcgcgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgktaataatactttgccctcagaaagattctgataccctgccttgacaacatgaaacttgaggctgctttggttcatgaatccaggtgttcccccggcagtcggcttcttcagtcgctccctggaggcaggtgggcactgcanaggacactggaatccagancgagcgcagttcatgcncaaggccccgtgatttaaaatattg

SEQ ID NO: 3833 - DNA, 1392 bp, Homo sapiens
  misc_feature (3)..(4): n equals a,t,g, or c
  misc_feature (6)..(6): n equals a,t,g, or c
  misc_feature (13)..(13): n equals a,t,g, or c
  misc_feature (18)..(18): n equals a,t,g, or c
aannanaactacntccgnttttaggtttagggggcctggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttcaaaaaaaaaaaaaaaaaaaaaaagctcgagggggggaccggtacccgggctga

SEQ ID NO: 3834 - DNA, 768 bp, Homo sapiens
  misc_feature (581)..(581): n equals a,t,g, or c
  misc_feature (675)..(675): n equals a,t,g, or c
  misc_feature (721)..(721): n equals a,t,g, or c
  misc_feature (723)..(723): n equals a,t,g, or c
  misc_feature (742)..(742): n equals a,t,g, or c
ggtactgtgttggcttgttttgcagtgagacttattctgagattaagagctgcatttagcttcttggccaccaggatcccagagtaaattacttttcaggactctacatagtacgcaggagatttgaaagaactgatgcaatttctaaagcagcctgacttcctcccaggaggttactcccacaccaagcctctgacttcatgaccaccagatttagaaattgaagtatctatgtaagaagttgcctcctaggcagaaatcaagaaatccaactataacataggttagagtccattttggtttttatatccttccacagaggaaagaggaggaagaatctggagatgcgtttttggtttttggtttttkgtttttttttttttccagaggctcatgtatatcctacatcatggkcagtttcagagcagggctgkgccaccatctcagtgactcctggaatactaaattggatctttgtagaggaagaaaataacacagttctagattttccctagctgttaattagttttatggcataattaaaatagctcaggagtaaaaacaaagtccagccttaacancctgttaagtcttcttttcttatctgaaaagaggtaagataatgaagtttaaacagttgaagaagttaaccgggaaaggaattaacatttcaanggccttgccgctttcttcctcctcttgtgatatgaaccagaattgnangggaaaatagggcagggangggaaccccacactggaaattttcca

SEQ ID NO: 3835 - DNA, 2087 bp, Homo sapiens
  misc_feature (17)..(17): n equals a,t,g, or c
  misc_feature (25)..(25): n equals a,t,g, or c
  misc_feature (73)..(73): n equals a,t,g, or c
  misc_feature (94)..(94): n equals a,t,g, or c
  misc_feature (1552)..(1552): n equals a,t,g, or c
cttcatctccctttcgnttaaggcncctcccttttttttttttccagaggctcatgtatatcctacattttgnttagtttcagagcagggctgngccaccatctcagtgactcctggaatactaaattggatctttgtagaggaagaaaataacacagttctagattttccctagctgttaattagttttatggcataattaaaatagctcaggagtaaaaacaaagtccagccttaacagcctgttaagtcttcttttcttatcttgaaaagaggtaagataatgaagtttaaacagttgaagaagttaaccggaaaggaattaacatttcaaggccttgccgcttcttcytcctcttgygatatgaaccagaattgagggaaaataggcaggagggaacccacactgaattttccagactctactgctgaaagacattgtatatttttattgtaatcatatgtgatgcaagataatattgctcatatctgaatcccaaaagaaaagaagatgtttgyctgagcatcccatgaggtaagcagccccatggaaggaccagctgcatccagcaaagggctccaggtccctgacgtagttgacggtgatggcagaagtaaatctttgtattcttgcagagactttgtttctgaaagaggccaaaagtcatttcaaactgaatctgacggataagataggggccatagctgagaaaaataagtagcgaagccgatctaaaccaaggtgtaactgtgaaatagtaaccatcttctttgcacgtttcaaaattggccctggacgccatcgcaagaggaaaattccaaagctgtgcagcagcggcagtaccattggaagagtttacagcctaccaggactacttagaaggggatcatgtttatttggatatataacccctgattggtttgttttaaaaataaacgttattatgttagtgtcatacctcatggtttccttggaacattctcctctaatcctctttgagagagtgggagggagagattgtgaggggagagagaagtgttaaacagagatgttcctaaggaggaccaggaatcctaaattacctaaataacccacttggttatctccactccttgatagcactgtgtgaggtatgatgcagtcaggtaaaggacaatttatctttgaagacaaagataaattcgagtccccattttcaagagtcagtgagaagtamcagcttgtttgtgtggcactgattgatccttgtccgggcaagtggtccctccacaggttatccggcttggcacacaacagacagaggtgctggcggactgtggaaccagacccgctgtggttcccctcctcaccctgccacttcctagctgtgcatcttggacaactgattgaatcttgtgcctcatttttctgtggaattgaaacaataccctgacccattgggcaatggagatcaaatggcattgatgcaggtaacatgcttaacacagggcctggtatgtagtgggcattcagtaagtggaagttacgattattattaggtatcaaagarcnaaacttaattgtcagawtaagcaaaccagttggaataataaacgtagcctttagagttaaatggcacaaccctgatagccacacataaactgttttggttatttttcgttggatattcccagtctttatttctacatccctcttcaggctgagtgcttaaaatacatttatatgtagtctcaattagattatgctgtttcccccaaaagactacagtgactattattttaatttatagaacctcgaattgcatggaatagctaccacatctccctttaaacctggtagcttccaaaacttcctgatggcgttttcgcaaatgggtccctatgtgtcattgaaggagacagtgtatctaggaaaagaaatgaggatactgagcaaggtgttggtggctcatgcctataattccagcattttgggagactaaggcaggtagctagcttgaggccaggagttcaagaccagcctggccaacacaatgagaccccatctccacaaaaaaaaaaaaaaaaaaaaaaaaaagggcggccgc

SEQ ID NO: 3836 - DNA, 2096 bp, Homo sapiens
  misc_feature (2070)..(2070): n equals a,t,g, or c
  misc_feature (2083)..(2083): n equals a,t,g, or c
  misc_feature (2090)..(2090): n equals a,t,g, or c
ggaggaacggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcattgtatgtgaaaagatgaatgtgtttctggcgcgtggctgntaaaactcttcanggtgccncaagct

SEQ ID NO: 3837 - DNA, 1707 bp, Homo sapiens
ccacgcgtccgggcctgagtcctctgacctctattcagaaatccctgccctgacccgctgtgccaaggttagcacctgccagaatcaaccaaggccggacaaggcatgaggagcgctgcttcctgggcctggctcctcccccttctccccatttgggctgctgtgccagggcttgctccagccacctgggtgtgagctatgccctctgccagaaatgctctttcctctattggcctggccacacctactcagtctttgggtctgtttaactgccacttcccccagtaaaccttctgctccccattcacatcagatggacttgtgtctcttgcactagtctatgagatttggatgtctgtgtccttagggcccaagctggccactctggcccagaagcagcctcgggccatgtcttgtctacagggtgtggggggacagtatgtgcacccccttgctttctcaggtggactttgaacagctgactgagaacctggggcagctggagcgccggagccgggcagccgaggagagcctgcggacttggccaagcatgagctggccccagccctgcgtgcccgcctcacccacttcctggaccagtgtgcccgcgcgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgaggtgggtgcccttccaggtcttagtcttgactgccacctccttggtttccttcgctcctcccagctcacccttcttctttctccagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtcttgtaagtaaccccccacaatcccactgcccacctgaaccccatcaaccccctccaaccctgctctgtccctgcagtgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaaaaaaaaaaaa

SEQ ID NO: 3838 - DNA, 1239 bp, Homo sapiens
cccacgcgtccgcccacgcgtccgcccacgcgtccggctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcsaggttttaattaattcccatactgataaaaataactccatgaattctgtaaaccattgcataaatgctatagtgtaaaaaaatttaaacaagtgttaactttaaacagttcgctacaagtaaatgattataaatactaaaaaaaaaaaaaaa

SEQ ID NO: 3839 - DNA, 1797 bp, Homo sapiens
ggtcgacggtatcgataagcttgatatcgaattcctgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaaggaatctgaggattatcagaacttcagcattccatccattcagtggcgcgagtccaggaaggtcatggggcaactccagagaagaaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggccccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaaaaaaaaaaaaaaaaaaaaaaaaaaaaaaaaa

SEQ ID NO: 3840 - DNA, 1140 bp, Homo sapiens
ctaggagcctcctaatgcagtgttctgcacagtcctggggactgactgactgaatcacacctctggggctgggggctgctgacatgtgtgcctttccttggctgcttcttctcctgctgctccaggarggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccarctattccctgcatatcagcaatctgagctgggaggattcagggctttaccaagctcaagtcaacctgagaacatcccagatctctaccatgcagcagtacaatctatgtgtctaccgatggctgtcagagdccccasatcactgtgaactttgagagttctggggaaggtgcctgcagtatgtccctggtgtgctctgtggagraaggcaggcatggatatgacctacagctggctctcccggggggatagcacttatacattccatgaaggccctgtcctcagcacatcctggaggccgggggacagtgccctctcctacacctgcagagccaacaaccccatcagcaacgtcagttcttgccccatccctgatgggcccttctatgcagatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccaccaaaaaaaaaaaaaaaaa

SEQ ID NO: 3841 - DNA, 738 bp, Homo sapiens
  misc_feature (646)..(646): n equals a,t,g, or c
  misc_feature (670)..(670): n equals a,t,g, or c
  misc_feature (696)..(696): n equals a,t,g, or c
  misc_feature (707)..(707): n equals a,t,g, or c
  misc_feature (718)..(718): n equals a,t,g, or c
catcagaccacacccagcagtcagaaaagaggtgcaggggcccgggctgggacagtgaagagtgctgggcagtctgtggtcctctgtatctcaactttttcatcttaaaaaaacaaatagggttgtgtgtgtggctggtggtcataaggtcctttctggctctaataacctgagcttctgttatgaagctgggacccttagagcctcaggatgatcctctgtttgtttgtgaagccccaatcaggtgctaagcaccatagtggcacttagctgaagctcctctgtaactcctgtgggccctgccttgcccacccccgacagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccargtattgaaggctctcagctttccaaagaaaaaggctgcactactctcaactgccatcttatgcttcctgcggacagccctgcgacaaagcttttcctctgcctggaaccctggtgcccttaagggcccagncactgcagccaccaaggacactgncctaacttcactgcgaatgtccaagnccggccctggncattgggctgnaaaaacctcctggtgcaaaa

SEQ ID NO: 3842 - DNA, 935 bp, Homo sapiens
  misc_feature (6)..(6): n equals a,t,g, or c
  misc_feature (14)..(14): n equals a,t,g, or c
  misc_feature (16)..(16): n equals a,t,g, or c
  misc_feature (50)..(50): n equals a,t,g, or c
  misc_feature (95)..(95): n equals a,t,g, or c
  misc_feature (101)..(101): n equals a,t,g, or c
  misc_feature (139)..(139): n equals a,t,g, or c
  misc_feature (176)..(176): n equals a,t,g, or c
ggccancttttttntnggggaaaaaatgggacccaaaagttatttgaaangggctttttcaagctttttcccaaaaggaaaaaaagggttgccantaattnttcaaggattgcccatctttaatgctttccttgggganaagccttgcgacaaaagctttttccttctgccctggnagccctggtgccttcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacaaaaaaa

SEQ ID NO: 3843 - DNA, 734 bp, Homo sapiens; identical to SEQ ID NO: 623

SEQ ID NO: 3844 - DNA, 871 bp, Homo sapiens
ggcacgagggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggagccccacccctctccatgaatgccttcccggctccatctcctacttgcaccccagaaccccttggcttctgtctgcctccccagcacctcagtttctctaccttctcaccctccctggcagcctgcaatgagtcctgtgccaggaaccggcggacctccctgtgggctgtgagtctcagcagtgctctactcctggccatagctggagatgtttcttttactggcaaaggaagaaggaggcagtaaaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcataaaaaaaaaaaaaaaaaa

SEQ ID NO: 3845 - DNA, 881 bp, Homo sapiens
gaattcggcacgagggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaagggagccccacccytctccatgaatgccttcccggctccatctcctacttgcaccccagaaccccttggctctgtctgcctccccagcacctcagtttctctaccttctcacctccctggcagcctgcaatgagtcctgtgccaggaaccggcggacctccctgtgggctgtgagtctcagcagtgctctactcctggccatagctggagatgtttcttttactggcaaaggaagaaggaggcagtaaaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcataaaaaaaaaaaaaaaaaactcga

SEQ ID NO: 3846 - DNA, 810 bp, Homo sapiens
  misc_feature (688)..(688): n equals a,t,g, or c
gatcctccacatccttccatggctctgaagaataaattcagttgtttatggatcttgggtctgtgtttggtagccactacatcttccaaaatcccatccatcactgacccacactttatagacaactgcatagaagcccacaacgaatggcgtggcaaagtcaaccctcccgcggccgacatgaaatacatgatttgggataaaggtttagcaaagatggctaaagcatggggcaaaccagtgcaaatttgaacataatgactgtttggataaatcatataaatgctatgcagctttkgaawawgttggagaaaatatctggttaggtggaataaagtcattcacaccaagacatgccattacggcttggtataatgaaacccaattttatgattttgatagtctatcatgctccagagtctgtggccattatacacagttagtttgggccaattcattttatgtcggtkgtgcarttgcaatgtgtcctaaccttgggggagcttcaactgcaatatttgtatgcaactacggacctgcaggaaattttgcaaatatgcctccttacgtaagaggagaatcttgctctctctgctcaaaagaagagaaatgtgtaaagaacctctgcaaaaatccatttctgaagccaacggggagagcacctcagcagacagcctttaatccattncagcttaggttttcttcttctgagaatcttttaatgtcatttatatacaaaagaaattctcaaatgttaaaataaaggaatagtttattgcttaaaaaaaaaaaaaaaaaaaaaaaactcga

SEQ ID NO: 3847 - DNA, 1092 bp, Homo sapiens
gctacgaccctgattacgccaagctcgaaattaaccctcactaaagggaacaaaagctggagctccaccgcggtggcggccgctctagaactagtggatcccccgggctgcaggaattcggcacgagcggtttccgcggtggccatgactgcggccgtgttcttcggctgcgccttcattgccttcgggcctgcgctcgccctttatgtcttcaccatcgccaycgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcaaaaaaaaaaaaaaaaaaaaaaaaaraaaaaaaaaaaaaaaa

SEQ ID NO: 3848 - DNA, 284 bp, Homo sapiens
  misc_feature (5)..(5): n equals a,t,g, or c
aggancccaatttttatcggggaaaatttttatcccccggttcgcgggcgggtggggatgtcagcgtgtcaggggggggggggggggggggggggggggggggggggggggggggggggggggggggggggggggggggggggggggggggggggcgttgataagctaccctgtctcaccatgtgctggtgtggaaacggggcccagccagcacgcctcaaggtagatggaatccccactggtcagagaaaaagctatgcggacactccagcttggcctgggtc

SEQ ID NO: 3849 - DNA, 1494 bp, Homo sapiens
  misc_feature (52)..(52): n equals a,t,g, or c
  misc_feature (453)..(453): n equals a,t,g, or c
agacttcatcatgaaattttagccaagtcttatgtccagaatggtatttctnaggttatttttcagagtttttatagtttaatgttttatatttaagtctttaatccttcttaagttgatttttgtatgcagagtaagctgggggcccagtttcaatcttctgcatatggctagccagtaatcccagcaccatttattaaatggggacttctttccccattgcttgtttttgtcagctttgtccaagatcagatgattgtaggtgtacagcattatttctggactctctgttatgttccatttatctgtgtgtctgtttttctactaataccatgctgttttggttactgtagctctgtagtatggtttgaggtttggtaacttgatgcctccccttttgttctttatgtttaggattgccttggctaggctcttttttggttccatatgaantttaaagtagtttctaattctgtgaagaatgtcattggtagtttgataggatagcattgaactatttgctcaactcaacattttaggaatttatttctgctgtctagtgctcaaaacttgcagctagaattgagggaagagagagaccttcttatattgttttatattgtttkatactcagtacctgttttaagaaaaaacaacaaggaagtaaaaccaaagacargcagcccrgcgccaggcccraaaccaggcctgggcctgcctggcctaaacccagtagttaaaaatcaactcataacttagaaacygatgttattcatagattccagacattgtatagaagaacattgtgaaactccctgccctgttctgtttctctctgaccaccggtgcatgcagcccctgtcaygtaccgcctgcttgctcaaatcaatcaygaccctttcatgtgaaatctttagtgttgtgagcccttaaaagggacagaaattgtgcaytyggggagctcggattttaaggcagtagcttgcygatgctcccagctgaataaagcccttccttctacaaytyggtgtctgagrggttttgtctgcggctcgtcctgctacatttcttggttcctgaccaggaaacgaggtaactgatggacagccgaggcagccccttaggcggcttaggctcccctgtggagcrtcmctgrggcggastccggccagcccgagtgacgcgatccaaagagcactcccgggtaggaaattgccccggtggaatgcctcaccagagcagcgtgtagcagttccctgtggaggattaacacagtggctgaacaccgggaaggaactggcacttggagtccggacatctgaaacttgatctccagcaccctgccggtggactactgagagacgaggtgccagggtggttcctgaaagtgcctgagccccaacttatcagcaaggagctcatcatgctgacagaagtcatggaggtctggcatggcttagtgatcgcggtggtgtcctcttcctgcaggcctgc

SEQ ID NO: 3850 - DNA, 1014 bp, Homo sapiens
  misc_feature (12)..(12): n equals a,t,g, or c
  misc_feature (16)..(16): n equals a,t,g, or c
  misc_feature (19)..(19): n equals a,t,g, or c
  misc_feature (78)..(78): n equals a,t,g, or c
  misc_feature (83)..(83): n equals a,t,g, or c
  misc_feature (124)..(124): n equals a,t,g, or c
  misc_feature (929)..(929): n equals a,t,g, or c
  misc_feature (1000)..(1000): n equals a,t,g, or c
  misc_feature (1007)..(1007): n equals a,t,g, or c
tggattcccccngggnttncaggaatttccgcacgaggttcttccccctgaacttggagggggggaaaaaggattttnagggncatagagtccacgggctgggcccaaacagcaggttccaggnttccaccgccccagtgatttccaggctctctggctgaaggctgcctgcctggaggggacatcagggaagaggcttccggagaggggatgggagaaagtaggggatgtggcttgagctgcagtcacaggccttggctggaccagggatggcccccagctcccaggagggcccactgaccctgcagctccagccttctccatacttcaacaaagaatgagttgtggcaatgagggaagagagaccctctcatagtgttttatactcagtacctgttttaagaaaaaacaacaaggaagtaaaaccaaagacaggcaggcagcctggcgctaggcccgaaaccaggcctgcgcctgyctggcctaaacccagtagttgaaaatcaattcataacttagaaaccgatgttattcatagattccagacattgtatagaagaacatttgtgaaactccctgccgtgttctgtttctctctgaccgccggtgcatgcagcccctgtcacgtaccgcctgcttgctcaaatcaatgacgaccctttcatgtgaaatcttyrgtgttgtgagcccttaaaagggacagaaattgtgcacttgrggagctcrgattttaaggcwgtagcttgccgatgctcccagctgaataaagcccttccttctacaactctgagaggttttgtctgcggctcgtcctgctacatttcttggttccctaaccaggaaacgaggtgactgacggacggctgagacagcccttaggcaacttaggcctgccccgtggagcgtccctgcggggactccggccagcntgagtgatgccatccaaagagtgctcctgggtaagcattgccccggtggaaggccttgccagagcagcacntagcagnccctgcg

SEQ ID NO: 3851 - DNA, 1038 bp, Homo sapiens
ggcacgaggcgcctcggacggccgtcggggccgagaaaccatgagccccaggggcacgggctgctccgccgggctgctgatgactgtcggctggctgcttctggcgggcctccagtccgcgcgcgggaccaacgtcaccgctgccgtccaggatgccggcctggcccacgaaggcgagggcgaggaggagaccgaaaacaacgacagcgagaccgcggagaactacgctccgtctgaaaccgaggatgtttcaaataggaatstcgtcaaagaagtagaattcggaatgtgcaccgttacatgtggtattggtgttagagaagttatattaacaaatggatgccctggtggtgaatccaagtgtgttgtacgggtagaagaatgcccgtggaccaacagattgtggctggggtaaaccaatttcagaaagtcttgaaagtgttagattggcatgtattcacacatctcccttaaatcgtttcaaatatatgtggaacttctaagacaagaccacaatccattatacttgtaaatgattcagcaatcctagaagtacgcaaggaaagtcaccccttggctttcgagtgtgacacactggataataatgaaatartagcaactattaaattcacagtctatacgagcagtgaattgcagatgagaagatcaagcctaccagccactgatgccagccctaatttttgtgctgaccataggagtcattatctgtgtatttataattttcttattgatcttcataatcataaattgggcagcagtcaaggctttctggggggcaaaagcctctacacctgaggtacaatccgagcagagttctgtgagatacaaagattcaacttctcttgaccaattaccaacagaaatgcctggtgaagatgatgctttaagtgaatggaatgaatgatgtttgaatgatatataacaaaccaaaggatattacagaatattagattcattattacaaaaataaaatacacattgaaatactttaaaaaaaaaaaaaaaaaaaaaactcga

SEQ ID NO: 3852 - DNA, 1147 bp, Homo sapiens
ggcacgagacccattgagcagaaggaggccaggtgggaaagctcctgggaagagcagccagactggacactgggctgcttgagtcctgagtcacaattcagaattcctgggctccctgggtgcattctatcattccagttgaaagtttgcttccttccagtcatgtggctcttcattctactctccttggctctcatttcagatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgaaggacacagggaaccagctcattgtcactatgtcctgcctgaacaaagaagacacgggctggtactggtgtggcatccagcgggactttgccagggatgacatggattttacagagctgattgtaactgacgacaaaggaacctggccaatgactttggtctgggaaagactatcaggcacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggccccacacctcagagactgattctgatctcccaggaattctgaaggtccctctatccttgacaacaatcatttgcagccaggtagcaacggcagtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaaaaaaaaaaaaaaaaaaaaaaaa

SEQ ID NO: 3853 - DNA, 1134 bp, Homo sapiens
  misc_feature (418)..(418): n equals a,t,g, or c
  misc_feature (803)..(803): n equals a,t,g, or c
  misc_feature (816)..(816): n equals a,t,g, or c
acccattgagcagaaggaggccaggtgggaaagctcctgggaagagcagccagactggacactgggctgcttgagtcctgagtcacaattcagaattcctgggctccctgggtgcattctatcattccagttgaaagtttgcttccttccagtcatgtggctcttcattctactctccttggctctcatttcagatgccatggtcatggatgaaaaggtcaagagaagtttgtgctggacacggcttctgccatctgcaactacaatgcccaytacaagaatcaccccaaatactggtgccgaggytatttccgtgaytactgcaacatcatcgccttctcccctaacagcaccaatcatgtggccctgaaggacacagggaaccagctcattgtcactatgtcctgcctgaacaaanaagacacgggctggtactggtgtggcatccarcgggactttgcmagggatgacatggattttacagagctgattgtaactgacgacaaaggaaccctggccaatgacttttggtctgggaaagacctatcaggcaacaaaaccagaagctgcaaggctcccaaagttgtccgcaagctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagwtttttttaatttagttncataaagtgatgnctacaacagawtaatcacccatgacaactggccccacacctcagagactgattctgatctcccaggaattctgaaggaccctctatccttgacaacaatcatttgcagccaggtagcaacggcrgtagtcagaggagctatgatagaccacacccaagcaaggctgccctcaaataacatctcaagatcttagttcttatgcattccatcagtcagaagtgaagaagaggtggagaatctkgattggggaccaggaaatcacttgtattttgttagccaataaattcctagccagtgttgaatgaaaaaaaaaaaaaa

SEQ ID NO: 3854 - DNA, 632 bp, Homo sapiens
  misc_feature (537)..(537): n equals a,t,g, or c
  misc_feature (579)..(579): n equals a,t,g, or c
tttgagcactactgggtggttagcatgattgaggaaaaatgatgggaataagaagtggaagtggtctttgtatcacaagttgaatttctcactttgagtagtagtgaagtcactactgtaagagctggtcagtgaatgtggttgcagcatggcctttgggcaagaagtaacccatttaactaaaaccagctggttggccccactcagatttatcaaagggttactgggtccctgggggtggatattgcttatattagacttagaatagcatactgttttaatattatatgaactaaaatgtttctttaaaaaaagagtggtctgttaatggatttatgtagtggtcaagaatttagacttcagagtcaaataaacctatatcagtcctagtcctacagtttactaattgtgagatgkcaagcaagkttttgaactcctctaagcctctgktttcttatctataaattaataaatgaatgaatcgggttgagtgaataattaagtaaaatcttaagacatactagttattggaactgngaaactgggttttttgggaatgggtttcacatttgggaagtngaaataccactttctaaaggtctggtttatctcaaatctctatccaggcctaa

SEQ ID NO: 3855 - DNA, 2036 bp, Homo sapiens
  misc_feature (521)..(521): n equals a,t,g, or c
  misc_feature (687)..(687): n equals a,t,g, or c
  misc_feature (1799)..(1799): n equals a,t,g, or c
  misc_feature (1807)..(1807): n equals a,t,g, or c
gtctcaaacatgcacgtgtacctttaggatgaatttctgcaattggatgtgccaaggccagagcgtgtgcatttgtggctttggttgacatcaccaagtcgcccttcctggggcctgtgctggtgtactctgaggcgcgattgtgtgaaaggtgggctaaggtgcctgttcgaccacatcctcactggtagactgggtcaccacagttttggaaaggtgagaaatggtatctaaacatagtttgaatttgcatttcttttactggaagggaggctgcgcgtgtttcacatcagagccacgtgtgtttgtggttgttgaactttctctcttggattgctaggagtgctttatgtattagggaagcagacttccctaatgcgtgataacgcatgcagatactgtttccaagtttttgttatttgtcttttaaatttgtttttgcatttgtcttttcactttgatttttgccaggctggagttttgatgtttatgtggtcataggtgtgaatattttcttttgnggcttctggattttgagacacagtggctatagaaccactatagccaaaagttatgtytgcttttggyttcatatactttgctttggtcctgtcttcttgactttatttaaaatagtaagatatwcttactacatttttccattgcccatagctggaaggagattgnaattatcaccaaagatgaaaaactaaggcatgttctcagcagaggcagattagactttaagttagaggcttgtccttggtgcagaggcctgtgagcgacccggccccacttgccctgcacaccatggcgtggattgtgggcagtcacagggaagatctctggctttgctgggagctggggtacggttcttagagtgccattctagagtggcttcgcgtactggtaatgaacgcccatcaagtggccttgggaattcatgagccggatgatgatgacttcgccggtgaaaagcaaatcccaaataggttgttttctgtgcattccagtcccaatttctcttccaagtaattattagatgtgccaagcctgttacgtttattacttacagaattgkttttgtctgtgtgagtttactgaggacttaggggttggtatgtgaggaggggagccccccttctyctgtgggcactctagcactcttaataatcagtattaaacatgttgaaggccataaaggaaataaccttctcttaaaaacaagttagagtcagtcataaaactgtttgcctagaccttgatcacttaaaataagatcttagatgtgatgtgtctttgtggagtatttcctgtggctcgggaggtgtgcatgagagtggggtctgagggacagtgaggggtgaaggaaaggtgggagagagggccttcagtgactgtaccaaagactcacagacactgggtgkcttggtgatgggtgcacatagcccttcttttgtgactgaagctgtgyggccttcatcccacagggtctgccctctccagataattctgtcactgaacttcaaactgtcaatggaacgatagcgcagtctcttaacaatgcttcaggacagataatagagctgtgcgggcagcctcsgtgacagtgttgggaatctgcagaatggctttgtccacttctttcctttcagaggagacattgagcctcggcatggtgtctcacgccaggaatcccagcatgttgggaggctgaggttgggggatcggattgcttgaggctaggagcttgaggtcagcctgcgcaacatagtgagacccctgtctctaccaaaaanaaaaaaanaaaactcgagggggggcccggtacccaattcgccctatagtgagtcgtattacaattcactggccgkcgttttacaacgmcgtgactggcaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaaagcg

SEQ ID NO: 3856 - DNA, 2694 bp, Homo sapiens
  misc_feature (258)..(258): n equals a,t,g, or c
  misc_feature (925)..(925): n equals a,t,g, or c
ggcgccgcgccgagcgaatctcggagtcggtgggtgcagatggcggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgargggccacgggctacactcggtcctggargantggttcstggagktgctgcagaacgatctgcargccaacatctyccctgarttctggaatgccatctcccaatgcgagaactctgcggatgagccccagtgccttttgctactccttgacgcttttggcctgctggagagccgcctggatccctacctgcgtacctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagtwccacaagtggatcgagcgggnggttggctggctcggcaaggtgttcctgcaggacggccccgccaggcccgcatctcccgaggccggcaacaccctgcgccgctggcgctgcacgtgcaaaggttcttctaccgcatctacgccagcctgcgcatcgaggagctcttcagcatcgtccgagacttcccagactcccggccagccatcgaggacctcaagtactgcctggagaggacggacyagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaaaaaaaaaaaagggcggccgc

SEQ ID NO: 3857 - DNA, 810 bp, Homo sapiens
  misc_feature (731)..(731): n equals a,t,g, or c
  misc_feature (733)..(733): n equals a,t,g, or c
tttttttttttttttcaaacaaaatactgttttactttgtttctcagccttttccaattttacgccagcgcggaatgaggcgccagggcggtgctcaggtgtggcccaccaggcgcggggtgcaggggaaggtcttacgcatgcccatgcacttctccttgtcgatgcaragggtgttggccttgatggcgagctcgtgctccagccggcacttggtcatgaccagcagctgcagcgtgtcctgtgtctcccgcagccgcagcttgagggtctgcagggtgtcgtcgatggtgaacacctcgttcaccagcttcaactgcgggatgtccctgcacagctccatgttggggcgccgggtccggcactccagccttgtctgggccaccktcagcgggccctccttggccatgatggacctttccagcagcatgatggtgttctcggcctggaagatctcctgcagcgtcttcgccagctgcgtctgcagcttattcttcacatccgtcacctcagagatgcgggcgttgaaggccaggttggtgtctgtgaactgcctccacatctgatccgacaaggtctcaaagaggtgctccgcctcctcccgcagctggatggagttggcccgcatgttctgagagtgtttgatgttgtcgttactgaacttggcccaggtctcaggtacggagatcgtgccgtcggtttctccatgccgtggaagaagctaatgccgncngaccggatttctcaggttaaagcacttctcatcgatacactggggggagcttttgtctaaaaggggctccttacccg

SEQ ID NO: 3858 - DNA, 2298 bp, Homo sapiens
  misc_feature (4)..(4): n equals a,t,g, or c
  misc_feature (1653)..(1653): n equals a,t,g, or c
gcgnccgcggcatggtcttcggaggggtggtgccctacgtcccgcagtatcgggacattcgcaggacgcagaacgccgacggyttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcaygggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcagagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcagntcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctgaaaaaaaaaaaaaaaaaaaaaaaaaaaaaaagggggggggc

SEQ ID NO: 3859 - DNA, 928 bp, Homo sapiens
gggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccaaaaaaaaaaaaaaaaaaaaaaaaaaaaaaaaaa

SEQ ID NO: 3860 - DNA, 1433 bp, Homo sapiens
ggcagagcacttatgtktttggcattctccgtcatcattctggccggggcgggcagttctaggagttggaactcagtcctggtggaaaaggaagtcgtggagggagggctagggccgtgggggaactgctctgctgagcctcttcctcacctgctgcttcctaggactaacctgaaggctaaggtaccaggctgaagtcagtgctcagaaaaccaatcgtcattctttggggttttttttcttgaagagccactttctctttaccttgttctagcctgttggaggtagggtttctgcaattccaaaggccgtacacagcctctcaccatcagaccactttttaaggctcttcgttcatacctagctcgaagattcacttcctcaggaagccattttagttacaaatctgggaaaacttaaaatgctttcattgtgccatgttttctgttgcagcttcagtaccgtacctagtggtcaggcatacttacaagtttctttttacagtaaccccttgtggacatctaataaatggtcattattttttagtactagtttgttttcctgaacactgtaagatctgtgactgacgtttgataccttaaagcagtgccatataataactacccactatttgttctttatttctgtcagataaaaatgttctatgtagtgtctacagtcattttttttttaactagaatttagatttggaagtagtttttctattagttgatttgcatgaaatacaaaattaggaaaaggcttattccacctcaacctagttgaactattaatgatttttttttttttttgaggatttgggctctttctagatagaaaatcaccctgaacttctagctttgcattgtgaagtgagcatcatgaagatgagaaaatgttgggagatcatttttgcaaagggcataatagtcggcattcagatatgagttaactgcagagggaaaattgcaagctgtcatgttggccttgttcctctcaaccttctggtaacctaacaagctcctacaggttgtatgtgaaattgcaagatgattatatagccctgttgaatttacaaccagatcttgctttcaaaccattattagccaagggtttgattccacacctgtgttcatggattttttggtattagacattgctgtaactctgttttcactttttcatctgttatcttggctcacttaagggagaaggtatcagcagcctaggaccacttggtttctgtttttatgtttcatagttcatggctgataaaaattacctgtccttaggccgagtgcagtgcctcacacctgtaatcccagcactttgggaggccgaggtgagtagatcacctgagatcaggagttcgagaccagcctggacaacaagagcaaaactccatctccaaaaaaaaaaaaaaaaaaactcga

SEQ ID NO: 3861 - DNA, 1369 bp, Homo sapiens
  misc_feature (1351)..(1351): n equals a,t,g, or c
  misc_feature (1353)..(1354): n equals a,t,g, or c
gggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggragaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatgggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccrtgaacaatgtccacatgaaacacacaggcaccatcccaggggcacaaggactgatgaacagttccctccttcatcaggtaggaaatggactgtgagccccatgggaatgcccatttcttctcccttaagatcttttgtcagctcagaaatgtgtttggttgggttggttggttggtttgtaaacagatattcagcttcatggtgtcttcttaaaaaaaaaaaaaaaaaaaaaaaamcycggggttcntnnaaaggggcccggggg

SEQ ID NO: 3862 - DNA, 1515 bp, Homo sapiens
  misc_feature (69)..(69): n equals a,t,g, or c
aattcggcacgagggaaattcaagcacttttcctaaaagaagggggaatggatgctgaaacaacacgtntcccacaaagggagcagacactgggcttgtgaagctgccccataccttccccacagaactggggtccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggyctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggccttcactccgttaaaaaaaaaaaaaaaaaaaaaaaaaaaaaaaaaaaaa

SEQ ID NO: 3863 - DNA, 1404 bp, Homo sapiens
  misc_feature (1351)..(1351): n equals a,t,g, or c
cgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggyctcagagcacttcttcgagtacaagaagagccgcagtgggaggcacgtcgtcttctacccaaccctgaagtccctgcaggtgcggctggagctggcccgggagctgggcgttggggtctctatctgggagctggccagggcctggactacttctacgacctgctctaggtgggcattgcggcctccgcggtggacgtgttcttttctaagccatggagtgagtgagcaggtgtgaaatacaggcctncactccgtttgctgtgaaaaaaaaaaaaaaaaaaaaaaaaaaaaaaaaaaaaa

SEQ ID NO: 3864 - DNA, 1598 bp, Homo sapiens
  misc_feature (1067)..(1067): n equals a,t,g, or c
  misc_feature (1069)..(1069): n equals a,t,g, or c
  misc_feature (1577)..(1577): n equals a,t,g, or c
aggaaagaacaaaggttatttcctggagaaaagacaatttattcaacaccaacragggactcatcatatgggcacaactctggtgtccttctatggagaaaacctcaagtaaagttttattctgcctttraaaatgcttccaaaagtagaccctgtccccacacaggtcaagactacagagaaggctttgtagaaatgtgtcacctatgtacacctgctacttacacatttcctcttttggaaaaatgagatacttagaataacargaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtatncntggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaaganaaaaaaaaaaaaaactcgtag

SEQ ID NO: 3865 - DNA, 819 bp, Homo sapiens
  misc_feature (786)..(786): n equals a,t,g, or c
  misc_feature (819)..(819): n equals a,t,g, or c
aattcggcacgagctcaaagagtaagaatccaagtgtgtgacattacatagctttgcatctatggaaacctaaatcataattgtttccactgcccaattatgttccttttcataacatttactattctggctatatttatcatagaacctaggaaccttagagttgacctgaatctaattaaatttcagacctcctggccaaagaccctagtggaagagcaaaactaaatcaacatattaccaatctcaagtatttctctgaggacccagaccactgactttttgttgtcattttcaggttgatcctataactgtatgttctacaatatctgtgctccaccagctcagtgaggaatcaacggaatatcaaaagtaaatattggtcaccatataccttttggtactagtctacgaaataattggctgaggaactgtttcatattaaagaaaagctaaaagcaatgtgtgatcttagattagacctatgattggaatgtatgtatattttatatacaaaatattgaggaaattgacaaaatttaaatacagaatatggattagataataggaatgtatcaaggtcaatatttaaaaagataatttcaacttttattttattcagtgggtacatgtgcagactttgttttacatagtacccaacagtttttcaacgcttatcccccaccctctagtaatctgcagwgwctattattgycatcttcgtggctattgtacatgggatccatacttgattttgctctcaacatgaacattattggtgtaganaaatgccactaagttttkgtacgttggcttttn

SEQ ID NO: 3866 - DNA, 501 bp, Homo sapiens
  misc_feature (1)..(2): n equals a,t,g, or c
  misc_feature (12)..(12): n equals a,t,g, or c
nnccccccaatnatatttttccaaattaattccaacataggaaggattccaccttcctagtatgttttcaaattgtttcaaacctgacctctttttgattgctctaccttccaaaagaaaagaagggaacactaattttcttycctgatttacttcattgttttcttctgttagattaactttacctataaaagattgtctcttgactttatatatatatatatgtgtgtgtgtgtgtgtgtgtgtgtgtgtgtgtgtgtgtgtgtgtatttgaagaggacatgtgcctccataaaaggaaataaaatgagagaatacattattgattttgtgaaatcaaaatatttgaattatggtttctcaatattcaaaaactcttgcagtttctgtacttatttcttctgatgcatagagtttcggggactacatatgtttcacaaccaaagatatccacttgaaataaaaacattataaagttaaaaaaaaaaaaaaaaactcgag

SEQ ID NO: 3867 - DNA, 2008 bp, Homo sapiens
cgggggctttctaacgggaaaaactctactaaagggttcaaaagctggagctccaccgcggtggcggccgctctagaactagtggatcccccgggctgcaggaattcggcacgagctcgtgccgaattcggcacgagtcacagaacacatccatggctctmatgctcagtttggttctgagtctcctcaagctgggwtcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggmacctggytaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaaaaaaaaaaaaaaaaaaaaaaaaaaaaaamctcgagggggggcccggtacccaattcgg

SEQ ID NO: 3868 - DNA, 675 bp, Homo sapiens; identical to SEQ ID NO: 677

SEQ ID NO: 3869 - DNA, 1162 bp, Homo sapiens
ggcacgaggcgccccggactcttctcagttgagagtgcggttcctgggcaggtttccacaccagttcctttccgcgtccttcggccctggctctggctgcctggcggaggtggggtagcatttgtcatttgcacactgctggctttatctttggggctgcaccccgaggcaacaaatgcaggatgctctgtcacccacatgtccaccaccatctggtttgccttttggctactttgactttctccttaaatgcttcctgtgctgagcaaacattccacagccagcagagcaatggagagttcatggccactcttcccagtatcagcaagcaatttggggtgatcgtttggaagcctcagaggaaagatgtcatcaggcttcctgtggctttgtccttcagcatggggctcggcttgctttcacctgccttaggaagatttctggcttctgagctctgatatggggagaagataagggctgggatctttgagtctgcccctagctgggtatgtgcgtccggtgtgcgggccttggagtttttggtaatgactcacttgtgctctttctgggatctgtctccctcccacatgaccccgtggggtccctgaatgactgttttagagtacccatgtgggttccctgagtcacagcaggggatgtttaataaggaggttagcactgagcttggggacgtgctgtcacaccagcaggacgctgcaggaaggagcaggctacttcctttcttgacgtgcaaataactcgtataggctaatcaacaggcttataagttaaaagggctaccgctcggccccttggggattccatcccctcctctgtaacttggagatgtttgtttctgctgcagactcagagggttgcgatgaagagtggtgggactgagttgagaagcttatcccttcgctgggtgggaggtttctaattgccctgttctttgggggatccttaagtccagcttccaggtgggggcagcgataggaccaagttctcctagtagtctctgggaagccacttgagggaagctgccggtcatgcccatgcacccattggtcttctgccagcaggccctgtaggtcgtgccatgttccatgtccttctgggttcttgggggagaaggaagctgttgaaaaaaaaaaaaaaaaaa

SEQ ID NO: 3870 - DNA, 884 bp, Homo sapiens
  misc_feature (873)..(873): n equals a,t,g, or c
ggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaaaaaaaaaaaaaaaaaaaancccaagggggg

SEQ ID NO: 3871 - DNA, 1265 bp, Homo sapiens
  misc_feature (766)..(766): n equals a,t,g, or c
ggggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaagttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcasggggccagcgggcagcagaacccctnacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatatttcataccttgtgttttcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagtaaaaaaaaaaaaaaaaaactcgag

SEQ ID NO: 3872 - DNA, 1012 bp, Homo sapiens
acgcgtccggaagtgggagaggtcgcagccccgccttctctacacaggaaagctcagtggcccccaagccaggatgtcccaagcttgggtccccggcctcgcgcccaccttgctgttcagcctgctggctggcccccaaaagattgcagccaaatgtggtctcatccttgcctgccccaaaggattcaaatgctgtggtgacagctgctgccaggagaacgagctcttccctggccccgtgaggatcttcgtcatcatcttcctggtcatcctgtccgtcttttgcatctgtggcctggctaagtgcttctgtcgcaactgcagagagccggagccagacagcccagtggattgccgggggcccctggaactgccctccatcatccccccagagagggtgattctgaagcccagcctgggcccaactcccacagagccaccccctccctacagcttcaggcctgaagaatataccggggatcagaggggcattgacaacccggccttctgagtcacctcctgcctggaatcttgccatcagcaacctcctccccagtgcctcctggatcaagctagagactgctggcaccccaggaatgtccctgcccatcctgccgtgtctctgttcattcttggatttaacttattactttttctgcttctgtttccaccccagctgcctctcttgtcctgagggttaggctggagtgacagtttccgcccaccccccagcccaagaaagaggctgccggaaagaaaatgctgaccattggaggtgcccaacagtagaatgggctactgtgaggggtagtaagagccccatttctggaggtatgcaaatcttgactggacagccagctctgagattttatcagggcacttctatacctgtgggacattggactggatgagccctgagccagcttccactcctacctgaatagagaactcactgcacccacccacaacacatgataaacacatgtcctcactgaaaaaaaaaaaaaaaaaa

SEQ ID NO: 3873 - DNA, 539 bp, Homo sapiens
  misc_feature (528)..(529): n equals a,t,g, or c
  misc_feature (531)..(532): n equals a,t,g, or c
  misc_feature (537)..(537): n equals a,t,g, or c
gagatacattccatgaatacctagtttattgagagtttttagcatgaaggactgtcgaattttgtcaaaggctttttctgcatctattgagataatcatgtggtttttgtctttggttctgtttatgtgatggactatgtttattgatttgcatatgttgaaccagccttgcatctcagggatgaagccaactcgatcgttgtggataagctttttgatgtgctgctggatttggtttgccaatattttattgaggatttttgcatcagtgttcttcagggatattggtctaaaattctcttttttttgttgtgtctctgccaggctttggtatcaggatgatgctggcctcataaatgagttagggaggattccctctttctattgatcagaatagtttcagaaggaatggtaccagctcttctttgtacctctggtagaatttgggtgkgaatctatcttgkcctggaatatttttggggttggaactcaaaaaaaaaaaaaaaaaaatcaaaaaaaaaaaaaaannannaaaanaa

SEQ ID NO: 3874 - DNA, 754 bp, Homo sapiens
ttaaccctcactaaagggaacaaaagctggagctccaccgcggtggcggccgctctagaactagtggatcccccgggctgcaggaattcggcacgagcactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtaggggctccaggggccatcactgcccccgccctgtcccaaggcccaggctgttgggactgggaccctccctaccctgccccagctagacaaataaaccccagcaggccggaaaaaaaaaaaaaaaaaaaaaaaaaaaaaaaaaaaaaaaaaaaaaaaaaaaaaaaaaaaaaaaaaaaaaaaaaa

SEQ ID NO: 3875 - DNA, 667 bp, Homo sapiens
ggcacgagcactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggcaccaaggcctggatggagaccgaggacaccctgggccgtgtcctgagtcccgagcccgaccatgacagcctgtaccaccctccgcctgaagaggaccagggcgaggagaggccccggttgtaggtgatgccaaatcaccaggtgctcctgggaccggaggaagaccaagacacatctaccacccccagtaggggctccaggggccatcaatgcccccgccctgtcccaaggcccaggctgttgggactgggaccctccctaccctgccccagctagacaaataaaccccagcaggccggaaaaaaaaaaaaaaaaaaaaaaaaaaaaaaaaaaaaaaaaaaaaaaaaaaaaaaaaaaaaaaaaaaaaaaaaaaaaa

SEQ ID NO: 3876 - DNA, 2025 bp, Homo sapiens
gcccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatrcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattaaaaaaaaaaaaaaaaaaactygaggggggcccsggacccaattsccctatagggggc

SEQ ID NO: 3877 - DNA, 1020 bp, Homo sapiens
aaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaagactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattaaaaaaaaaaaaaaaaaaa

SEQ ID NO: 3878 - DNA, 3306 bp, Homo sapiens
ccacgcgtccggcccagggctgtctgtctccaaagcccaaccataactcacatccccattccagctcctctgggtgagtctgttccccctcagcctcactttccttatcctgtcaaatgaaggatttggaatgacttaagttattcaagcaacaaacacttactgaattgtcttgccacttccagggtgacattatggagttctgtgattctgcaagaggccagaggggacaaggtcaagtgggtgttcacctggcccctcatcttcctcctgtgcgtcaccattcccaactgcagcaagccccgctgggagaagttcttcatggtcaccttcatcaacgccacgctgtggatcgctgtgttctcctacatcatggtgtggctggtgactattatcggatacacacttgggatcccggatgtcatcatgggcattactttcctggcagcaggacaagtgttccagactgcatggccagcctaattgtggcgagacaaggccttggggacatggcagtctccaacaccatagaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgtcctcctctcccctccttcccccaccacaggtctctcctgcataggcagccactgtccgttctttcacacactggaaggaagagccatcgtggtctttgtctggccacagccaagctgctgggcatcctcctcctccttggagttccacccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcacccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaagagacaggatctcgctgtgttccccaggtaggtcttgaactcctggcctcaagtgatcctcctgccttgacctcccaaagtgctggattacaagcgtgagcccctgcacccggcccaagcagttgcttctttttttctctttttttttttttttgagatggagcctcactctgttgcccaggctggagtgcagtggcgcgatctccactcactgcaagctccgcctcccgggttcatgccattctcctgcctcagcctcccgagtagctgggactacaggcgcctgccaccacacccagctaattttttgtatttttggtacagacagggtttcaccgtgttagccaggatggtcttgatctctgatctcggatccgccaccccggcctccaaagtgctggattacaagcgtgagccaccgggccccgccaagcagttgcttcttatgcaacatgttgggtgggacttgtccacgggccaggccaataaaattcttaatcctgcagagagcagtaccctcatcaccccatcactggaaaacaaatgtttaagctatcaagagagggaatgtgcagcttggttctagatgcatggtttggaggatctaccttggcctaaagggaatgtcccaaacaacagagccttctttgctgcactccagaattctctacacagaatttcccaagtccattcaggacagacgcgcagtcctctttcaatggaagaagagaggacttttcccctcctgaaaaatgactggagtgtgaacaaggcagctctgtttttctaaataagttgttcttgtgagttttttctggccactgggcatctctgccctcacttttcatccctgccctctaagctgcagaccccatgaccacactgtctgcttccttgagcttcccgcacgaggcttgcacctgggggacctggagaccctgcggacagaactgtggctgagccactgtggccaactcttggggagctccacagtgggggttgctggtctgtgaggctgagtctccatttcagagcacacactccctggcagggcgcctccgcctgtgtctcctgcccagcagccgccagcagggaatagttgctggtgtctgagcacaaagagagctttgattacctagagaggaaaaaggctgtcagccagatgcagccaggcccaggggtagatacaggagttgctaaggaaggggccgagccaggagaggccaggcagatccacaaagcccaaggggatgcaggctgggtgtggtttctgagggaacctaccaaatagcaggtagatggaatcagaggactcttgtgtcctgaaagaacctccttaaaaacaactaaaaccaagaacttctggggctgttcacacattgttcaagtcaccccaagatcgttctggcacgctgagctgaacaccaccatctttgttcattctctctctaatgggcaaagcaggatcatcgagttgaaaagttgtaaataatgaggatatttatcccgctatttattttttcaataactgtgacctcctgcactgtgaatgctctgtgacatgagattcttagtttaataaaactgtcattaaatttgaaaaaaaaaaaaaaaaaaaaaaaaaaaaaaaaaaaaaa

SEQ ID NO: 3879 - DNA, 2194 bp, Homo sapiens
  misc_feature (441)..(441): n equals a,t,g, or c
  misc_feature (987)..(987): n equals a,t,g, or c
  misc_feature (2034)..(2034): n equals a,t,g, or c
  misc_feature (2041)..(2041): n equals a,t,g, or c
  misc_feature (2121)..(2121): n equals a,t,g, or c
  misc_feature (2169)..(2169): n equals a,t,g, or c
  misc_feature (2184)..(2184): n equals a,t,g, or c
ggcccagggctgtctgtctccaaagcccaaccataactcacatccccattccagctcctctgggtgagtctgttccccctcagcctcactttccttatcctgtcaaatgaaggatttggaatgacttaagttattcaagcaacaaacacttactgaattgtcttgccacttccagggtgacattatggagttctgtgattctgcaagaggccagaggggacaaggtcaagtgggtgttcacctggcccctcatcttcctcctgtgcgtcaccattcccaactgcagcaagccccgctgggagaagttcttcatggtcaccttcatcamcgccacgctgtggatcgctgtgttctcctacatcatggtgtggctggtgactattatcggatacacacttgggatcccggatgtcatcatgggcattamtttcctggcagcanggacaagtgttccagactgcatggccagcctaattgtggcgagacaaggccttggggacatggcagtctccaacacyataaraagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgtcctcctctcccctccttcccccaccacaggtctctcctgcataggcagccactgtccgttctttcacacactggaaggaagagccatcgtggtctttgtctggccacaggccangctgctgggcatcctcctcctccttggagttccacccctgsaaggcygatttgggggccattatctgagcagcttcaaagacccctgarctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcacccacagtttggaaggggcaagacctcaacctgttggggtttagggcccatgatggcagacattctaccccttttcctggaaaaactggaagaatgaaaatmatttttttctgtggaagagagaaaatgagtgaatatycttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaagagacaggatctcgctgtgttccccaggtaggtcttgaactcctggcctcaagtgatcctcctgccttgacctcccaaagtgctggattacaagcgtgagcccctgcacccggcgccaagcagttgcttctttttttctctttttttttttttttgagatggagcctcactctgttgcccaggctggagtgcagtggcgcgatctccactcactgcaagctccgcctcccgggttcatgccattctcctgcctcagcctcccgagtagctgggactacaggcgcctgccaccacacccagctaattttttgtatttttggtacagacagggtttcaccgtgttagccaggatggtcttgatctctgatctcgngatccgnccaccccggccttccaaagtgcttggattacaagcgtgagccacccgggccccgccaagcaagttgcttcttatgcaacnatgttgggttggggacttggtccacggggcccaggcccaataaaaatnctttaatccctgcanaagaggccag

SEQ ID NO: 3880 - DNA, 1940 bp, Homo sapiens
  misc_feature (5)..(5): n equals a,t,g, or c
  misc_feature (1573)..(1573): n equals a,t,g, or c
tcganccacgcgtccgcggacgctgggcgcaacaaagccttctacttgagcagtttttccatcactgatatgtgcaggaaatgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaagaagagaagaacatttcatttttcatctacrytttgaaccagtgcttcctaatgacaatgggtcataccgctgttctgcaaattttcagtctaatctcattgaaagccactcaacaactctttatgtgacaggtgagttctcaacacctagaccatctgatatttttcttataatgtttccaggaagaggggggttcagtttctcaagtgattatgttagaaagccaactcctatagcacatctgaaatctgctacacctcacagattgttatgtgccagtgtgtacatatgtgtgtgtatgtgtgcgtttgargtgagtgagatagaggagagtagakaaatagatagtaaaagttattgtttttgactttagggattataaaatttatttgataagtccaaaagtagaccactgaaatattgaaaaaattataaagtgaatacctatagttgcgaatagctctgtgattgcttgtccttctttgttgttttttttttctctttttcccatttttctcttctttacttttgttcattacaatttcttgaagttatgtttgtggtgcttaggcaattaaacacttcttaatagttcacagtttgtttagaggaaaaacagcaaacaactaactgacttcctagtgattttctgggaatattcagagyttcatctytyttccctgttccccgaaagaggcctttaatatgctttgacaactgaggaaggacagatagaagttaagcttggggaaaccaagctgaataaaacatgaaaaaatacatagggggggagtaggtaagagtaaaaaatacttggtttataaaaattttatagccaacatcatattcaatggtgaaaggcttagagctttccccctaagaacaggaacaagacatggatccttgcttttgccatttccatttaacattaaactgaaaattctagccagagcaaacaggcaagaacaagaaataaaagatatctaacttagaaaaaaagaagtaaaactttattcacagatggcatgaacttatgtgtagaaaaattcttaaaaatttgtttaaaactattaaagctaatacatgaatttagcaattccacatgatacaggatcaacacacmaaaatcagtgatatttctatacactagcaataaacaatccacaaagaaaattaaggaaacagttccatttacaatagcatcaaaatgaataaaatatttnagtacaaatttaaccaaagaggtataagagttgtacactgaacaaagaaagcatggctgaaagaaattcaagaatatgtaaataaatgcaaagacattctgtattcatggactgaaagatgtaatattgtaaagatagcaatattccccaaggtgatctacagattcaatgcagttccactaaaatcctaacagctttttgttgctattgcagaaataaaaaagctgatcctaaaattcacattgagttgcaacagacccagaattgccaaaacaatcttgaaaaagaacaaaactgaagctaagacttccctatttcaaaacttactacaaaatgacagttaaaaaaaaaaaaaaagggcggccgc

SEQ ID NO: 3881 - DNA, 432 bp, Homo sapiens
  misc_feature (420)..(420): n equals a,t,g, or c
  misc_feature (422)..(422): n equals a,t,g, or c
  misc_feature (428)..(428): n equals a,t,g, or c
gggcggaaccagyctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggargtgtgtttggccgcaggattcacctatgtgccgctctgctgtggaantngggtanaaga

SEQ ID NO: 3882 - DNA, 794 bp, Homo sapiens
  misc_feature (5)..(5): n equals a,t,g, or c
  misc_feature (760)..(760): n equals a,t,g, or c
  misc_feature (769)..(769): n equals a,t,g, or c
ttccngacccyggsctgmgggggcacaccaagagaaagaagagaataccamggacataccycagtcacctctggatccctggkcctgcacagagcctggctcataggagacactggagaaatgctcctaacctttggctagcccttttataatttatagcgattatctcatttaatgcttacaaccaccatttgaggtgatccattttacagagaaggaagcagaggcttttaagaggttaggtaagtcttagccaaagccaaatagcagctgaacagtagagctgggactccatcaaggtctcccagccggagcttgctcctacccctaggacaaggggtggactcctgactctgcagataaattctacaaaagccacagaaggcaagtagtaaccattgtgtgacaacccctcacccccaggaagaggggcccctgtgaggattgcaggctctggagtcacactgcttgttgaaacgctgcctcttaccctccctaggtctgcgcctttgaataagtatcacktcttagttgctccatgcctcagtttgyccatctgaaaatgggggcatctgtaatgcctgtgktatgaggagtaaattacagcatycctgtgaagacgtarcacagtgycgagtacggaatggtatttccatccttctacggagcttggtcccttycccttgcctttacttgcccagccattgaytcatactacttccttcttgcaggcattggtccagtgctggcctggctgggnccgttctangctcagcagtgaccatgcgtggacg

SEQ ID NO: 3883 - DNA, 1019 bp, Homo sapiens
  misc_feature (58)..(58): n equals a,t,g, or c
gcagcttcggtttaatggtaggttcttgcaatgggagtttctaggatgaagcgactcntccatgggatttgaacatataaagttatttgtagggaagagtcctgaggggcaacacacaagaaccaggtcccctsagcccacagcactgtctttttgctgatccacccccctcttaccttttatcaggatgtggcctgttggtccttctgttgccatcacagagacacaggcatttaaatatttaacttatttatttarcaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttyttatatgttaaaaaaaaaaaaaaaaaaaaaaaaagggcggccgctctagaggatccctcgaggggc

SEQ ID NO: 3884 - DNA, 1315 bp, Homo sapiens
acgcgtccggacgccgccacctccggaacaagccatggtggcggctacggtggcagcggcgtggctgctcctgtgggctgcggcctgcgcgcagcaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccacttcaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcacataaaccaaaaaataacttgttatcaataaaaacttgcatccaacatgaatttccagccgatgataatccaggccaaaggtttagttgttgttatttcctctgtattattttcttcattacaaaagaaatgcaagttcattgtaacaatccaaacaatacctcacgatataaaataaaaatgaaagtatcctcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3885 - DNA, 1138 bp, Homo sapiens
gggcgcctgtagtcccagctattcaggaggccgaggcaggagaattgcctgaactcaggaggcggasttgcagtgagccgagatcgcgccattgcactccagcctgggtgacagagtgagactctttctcccaaaaaaaaaaaaaaaaaaaaagtcaaatgcagctgggaatgtggttcgtgcctttttgtatattaaccatttgaaacttggttgtaaggtggggttggcaatgtcaggcctggctgcagcagctcatgtctttagagtgtgcctcttccctctctcgtggggctcgagcaagactaccttcatacatgggctctccagttacatagcaactccagtgttaaattccatcttttcttcctggaaaagccgtagaaaggacacctggacatgcctgctgcacaggttgtctgccttccccatcagccscagaaggaggaactttgctctcttctctcacagctgtgtgtgcataagaagtagttcggatgatgtgggtcccaccatgtattccttctctgttccatgtagagtaaaataaatgggagttctgtttaatgcatcacctcggttcatattgcatttgccaagaaagtgcaattttattgaacattaggattgaattcttaactgagtaatcaatttcagtagtaagttaaaatgccttctattaatggacaactgcaaccgttaatcagagttacagtagattaacagttgtcagcatttatgctaatagcactaataaaccgtgggctcatgatttgcactttataattccatatttctcaaaacagttggtaatactttttgcttgaaggtattgattcttttgtccctttgcttgctacttggagatgtagagaaagctaaatgacattttcacggtgatgacacaatatcaccttctgcttttgcacacttggctttgtgtcaaaatagatggaaagggttcatttgttctggtgctctactgtttaatttgatctggtgtgtgactaaagcaagacaaatagtatttttaatgaaaccatttaataacctctggtagcttagagtcgaaggcattggaaaaatgcaattaaaggatgcctagatgtaaacaaaaaaaaaaaaaaagggcggccgc

SEQ ID NO: 3886 - DNA, 314 bp, Homo sapiens
gtcgacccacgcgtccgctttgaggagcattcctctagattgcacaagggacagtgcctttaaccaagcgaggagtccaaagctcaggacctgactaccctgagggcacgctgacgcctcttcccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcaaaaaaaaaaaaaaaaaaagg

SEQ ID NO: 3887 - DNA, 3599 bp, Homo sapiens
  misc_feature (2675)..(2675): n equals a,t,g, or c
gggagggcaacggggcggcgcgggcggccgggcgcagggtckcgggargtgacrcgcggcgaggatggcggcgcggggccgggggctgctgctgctgacgctgtcggtgctgttggcggcgggcccctccgccgctgcggycaagctcaacatccccaaagtgctgctgcccttcacrcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctycaagctcaaggctcgcatccaggaggctgtctacaagaatgtacgccctgcakaagtcaggctgctgattttggaaaacatccttctgaacccggcctatgacgtctacctgatggtgggaacctccattcactacaaggtgcagaagatcaggcaagggaaaattacagaactctycatgccttccgatcagtacgagttgcagcttcagaacagcatcccgggccccgaaggagacccaacccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgtgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagcatcactgccactgccactggctaccaggagtcccacctcagctctgncagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttccccttcatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcarccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaagtgctgctgctaagggcctgtctcttatacacatctcaacctgcagg

SEQ ID NO: 3888 - DNA, 2924 bp, Homo sapiens
  misc_feature (33)..(33): n equals a,t,g, or c
gaggcccttggtggccggtgcctttgggaatgnccggtgaccttcactgtccacttccrcgacaactctggagatgtcttccatgctcacagttcggtcctcaactttgccactaacagagacgactttgtgcagatcgggaagggccccaccaacaacacctgtgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcggccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtcttggaccccgcggctggcagccaagggcctctgtccactaccctgaccttctccagccccgtgaccaaccaagccattgccatcccagtgacagtggcttttgtgrtggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcmggccctagagcccggcctgggccaatgatggagggcggccrccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaaaaaaaaaaaaaaaactcgtgcgaatcttggcctc

SEQ ID NO: 3889 - DNA, 5811 bp, Homo sapiens
  misc_feature (2809)..(2809): n equals a,t,g, or c
  misc_feature (2827)..(2827): n equals a,t,g, or c
  misc_feature (5787)..(5787): n equals a,t,g, or c
  misc_feature (5803)..(5803): n equals a,t,g, or c
aaatttttttttttttttttttttttttttttttttttttttttttttcaccascacggcttctctccagccttctctttattttctccagggcaccagcccctctgccagcctgagtccagggctcctaggcactctaccttgcccttgccattcccagggcctccccgcggccccgcaggggagggaggctcagagcacagtctcggcagtgctagggtcatcgaggaactggctgacgcgtttggggtgctgcaggcctggcgcggggtccactcccactcctgcctccttctgctcttcggtgtcctcgtccttcccctggtccttggagaagtacaagaatacctcctccagcatcgtctggctcacggaaaagtcctccacgccgtgctctgcgccgtgcaccgccagctctccaaagacgcgcgccagggcgcagcgccctcccggcggcagctggaagcgcaggcggcctccatgtgcctcgcgcagctccgmcccagggaactcggccgccacgaaggccgctgccggctgggaccttgcggcgggcacccgcagggtcagtgtgtgacccgccgcgaatctgcccttgagatgttgcgggctgcccaggcagcggaaccgcccattcaccatgatggccaggcgcgagcagagcgcttcacactcctccatgctatgggaggtgagcatcactgaacggccctcccgcaccacggccaaaaggctgttccaaaggaagcgccgcgcgctggggtccatgcctgtggtcggctcgtccagaaacaccacggctgggtccccaaccagcgccagggccgtcgccagcttgcgtttgttccctccgctgtaggtgcctgcaggccggtctgcgtaccatgagagtcccagacgcgccaggcccgagccagcggtctgggcaacctgggcctccgggacaccgcgcaggcgcgcaagcagctccaggtgctcgcggcccgtcagcagctcaaagatggcatcggattgagggcagtatcccatgctgaggtgcgcagcactgggttcccgggccacgctgtggcctgccagcacagcctcgcccctgctggccaatgtgtcccccgtcaccatgcgaaacgtggacgtcttccctgctccattcacacccagcagcccaaaacactcaccagggggaatccccaggcacaagcggtcaacagctggcatcctctgcccacggtataccttggtcaagttcctcagcaccaacacatccccctgggtggctccttggaccacccgctcccgttcacgggctacatcctcgtcctcctctcccaggagtggcagagacctcaccctgggctgtggcaggagttggcttcggtgctgcagcagtagtgtgaagagaaggaagaggggcccctgtatcaccatggccaagaggttcttgccgaccacctcccagcgcaggggtgactggaactgcctgtctcccaagcgctcaaaggcatcagccatggcctggttccgcaccatgtcaatgagcccccggcccaagcagaagtgggggaagataaggaagacctgtttcaagatccggctcacctcctgcagcttctgatcagagaagagctcaagcacaaaggtggccatgcttccattgatgccaataaagaggtttatgcaggtgagcaccacataggctgtgctgggcacggagaagaagaaggaggctgggtacatgagcggtgtgatcgaccagccatacagtagtagcaacagcaggagagcaggcaggttggcaggggccacatatgccctctgctggaaggccagaaagatgagcaccacgatgcatgctggcaccaagtagttacacatgtcccagagaaagttgccaagccagtagagggtgggggacaggccccccatgagctgcaggtgcttggctcgggtgactcgctcctcaatgaggacaagagtgaagctggccgggacaaaggacatggcaaagaccacacagatggagacgaggacgtccaccgaggaggccatcagtgcaccctcagacagctgctccttggtgaggttcaaggggtggttgagtgtggtgatgctgtgggcgtggcgggccgggcctgggggcaggtgagcacggaggattgcgttgctggctcggttgacaaaggccaccatggagtgccagcctttgttgttgaaccagatcttgagactgtcctgagcatccaggctgtgagcccaggctgtgaggtttttcaggacacggtcgagggccccgccaggcaggggactcagcagcgcccacaactcctccactgagcggcccaactcttggcccgagggcaggcctgggtctcggccccccagcgagaagcctccgtatctgacctcattcacccacttcttagtcttcaggccctggcgcaccaggcgcgggtaggtcttgaccaggaagtcagacaggttccggcctgtcaggttctgaaccacttccccagagccggtcactgcctggggcggagggggaccaccagctgcagccgggcagtcgggcagcaggcgccgggcaccgggccggctacactggcaggctggggatggagactctggggtccagttgccactggccaagaccttggccacttcagcaggaacttctggtgccgagaacctgtgggagctatgctgcactgggggctcctccagtcctgcctcctgcagcagcgcctcgagcagccgggcacgtccagggtcccctggggcgtcctcactgggcgaacaggacgcggcgcccccncccccccccccccccccnccgcttgagaagcagggcctggagctgctggcgggtcagtgcccagccctgtacccggcccacggcgtctggcccagagccctggtcagtctctggggctgacccagctggttccccgttctccagcgctgtctcctgtggcggcatcttgagccgtakggttacgtctaggccagcaatgcctgtgcataggtgctgcccgcagctgccatcctccatatctgtgtccgcagcacactcctccaccaccttcaggaagatctcctcgaggctggtgtcggagatcccgtagccagtgagcctcagctccgccagccgcgtgtctagctctcggaagagtgtggcgaagctgccgtcatgggcacccgtgtagggcagcaccagcaccagctcgtgtggcagctcctccaccagccgtgccccgggcacccagtgctgtaccagggccagcagctgaggagtgccgactctgctgccctggctgccattcttcttttcctgcctggtgtccacactgccctccatgtcagtgtcagccttctcattggtggtcaggggcaggcgggccttcaccagcgtcaggtagtagccggagcccaggtgacggcgcaggaagagtggggagccacagcagcacaagcggccacctgccaccacggccacacggtctcccagcagctctgcctcatccaggtggtgggtggagaggatcagcgtgcgaccttctcggtatttgagcagcagctcccaaataccgcggcgggaagcaggatccacgccagccgtaggctcgtccaggataacaacttgggmgmcgcccacaaaggcaatggccacggacagcttccgttgcatcccaccagagaggtggcgagtctgcacactctgcttggagaccagccccacatcctgcagcagacggtcctgctcggggcccactacagcggcactcagacccttcagccgcccatagaaccagacgtgctcgtccacggtcagcatgtcaaacagcacgttgtactgaggacagacgcccaggtggggccggatggcggccatgctggagcggacgtcgtggcccaggatgaaggcagagccaccactgggtgggaagaggccactcaagatggacagggtggtggtcttgccggccccgttgtggcccaggaaggcggtgatgtggccctggtagaagtccaggctgagcccccgcagggctggctgcgggcttccaggaaagcgcttctccaggctgcgaacggagacgccaggactcaggccgggcggtgcctcttctaccagcacctttgggtccagcggggtggggcaaggggctggactcttggggggccgaggtccgcaccagtagctcctccgaaaaggaaaattccatggttcagggatcccgtactggcctgggcacacagcttccaggtaccaggtggcgaggccgtagagcgccgcgtccagcagcagaaggccagagacctgggccaggctgaagacgtctgccgtaggccgggtgcccacgttgtgccactgcgcgccctcgccctgytcctccagcagagccaggctcttcgcagccgaagccgaaaggccacgggcgacagcaggctcgcggccacgcggccacccgcgggcagccggtcccgccaagccacacacagcacgtagggcaggtagagggagaagtaggccaggccgccgcaggccgcagccaggttggcgcgggagaagaaggcgctgagcaggaagctctgggtcaccgtggccaccgcgaaggctgccaagaacaggaagaccacgcccgggtggctgtaggggaggatgtcycccagcttgagcaccagaaccagcagygcggcgctgagcaggaagggcccgaggcagctgaggaaccagcctagccagagcaccgcgcggctgagccccatggcgcgcatggtgtcccgcagccgcgtctccttctcccgcaccacggccttcactgtcagtgtcacggagtagatccaggccagcgtcaggaagagcggcagcgaccggctcagcacacgcaggaacacgtcgtccacatagcacggatagggcatctgctgcaggtagaggccggcccgggggttggcgccgctgagcacgcggacggctgcacgctccaccaggtcttgcaggtacacgaagccgccccacacgtagcgcaggtcggtcagggggtccgcggctgggccagggtcccaaaacctgtccctgatcttattggtcctcgtgaccacgtcaatgtccatgcggattttgatgcgcacgtgccggggcccaggtctggggttgggtgctctgtggggtctgaagagtcctcaggtcccaagaagacgacgccggcccagaatcgatgttccgcgagcagttgcagggcccgcgacaccagggctgcctctgagggtgccgcctccagcttgtccaaggacaggcactccgtcactcggcccagcgtgcccaccaggtgccccacatcagcgtgtgcgtcctgccagctgtagccaccgctcccagggtccagaaaggatcgcagggcctccatgtggtcccggcctccaggtctgggctgccttcttccttcatcctgcatctgcaggagccgctgcagcatggccmcattggaactgtcgttcatraaggtgaagawccggggtcccagcatctcccacacctcccggacatcccycagcagggtgagctcctcgaaggtccggttcacctgggccatgagcttccgggtaaaaggtgtatctggtgcaaagagtagcttcccgaggatcagaggcttcaggcgtctccagagcaggcgggacagcgggtggctgtccagggctccaatcagctccgagcaggcggggctcaggctgctgtctggcagggcggattctggctcctgccccaccagctccatcaggtcactagcntcgtaccagtgaagtnttcctttc

SEQ ID NO: 3890 - DNA, 1012 bp, Homo sapiens
  misc_feature (19)..(19): n equals a,t,g, or c
  misc_feature (956)..(956): n equals a,t,g, or c
  misc_feature (970)..(970): n equals a,t,g, or c
  misc_feature (981)..(981): n equals a,t,g, or c
  misc_feature (989)..(989): n equals a,t,g, or c
  misc_feature (999)..(999): n equals a,t,g, or c
gccatggtagcatatgtantacattttctttatccagttcaccgttgatgggcacctgggtttactccatgtctttgctattgtgaatagtgctgcgataaacataggagtacaggtgtctttttgatagaacaatttgttttcctttgagtatatacctagtaatgggattgctgggatgaatggtagttctatttttagttctktgagaaatctccaaactgctggaaaacaagttttaatacacaagcaccctctttccccacctacagaaccttgacctcctttctagattgatctctgctaatcaccctcccactcccccaaccctggcttgcactagacttgtttgctattccctggtaawtctcatgagcattggctgaagcagtttctctkttctgaaataccctgaccctccgtacctagctaggcttttctccaggcagcatttatgaggccggtgttgtctgagtgtcctttgtggccaggcaggacagagcaagggcaagatgcttgatatatgctgacaagacaccattctagccgcacagatattccagcaaattggaagaccagcgtcgtccattcttgcaccttgcacctttttggtacctttgtcccttgtgtctggctttggagttaggatgggtctgtctgtcctccacgtagggagttagagcgagtttcatgttgcaccccacagagccctgcacggggatttgagaatggtaggcctccagggaatgttttgtatccaactacatgatttagggggcacaaaaatttctccctggccctgtgagagtcagagctgagaagcatcgagaaagtgtagctctgggcgtggataactaatcagactgcataaatgacaaaagccctctcatcccacagcaggttattgggagtcgtaccttgacttcagttcattttgctcacatagaccaaaaagnaaagcccaagaaangacaatttggngaacttcngtagaaggtnctgtaagaagatc

SEQ ID NO: 3891 - DNA, 734 bp, Homo sapiens
gactgcttatatttggcattgtcttttccctggcactgccactgtcaccaccatcccccttctggatccctactttaccccttcatgctgctctggtggcagtgcctctgctgccatgctgtacttgagcctgctgctacagccatgcctgaagatgcagccccttcctctcttcctgtcccaccaaatatgaccagctctaggttccattacttctggactttgctccaaataaaacttacacaattttattccaaacccaggtctctttctgcaacacccgagaaaaatattgggctgcaggagccagagaggagagagagatttactggtgagagttgtaggtgggaattgaaagccaagtcatgtctttgccccaccagaaactcactaggatgtacacaatgccactgtgatggtkttaaaatatgtaactaacctgcacgttgtgcacatgtaccctaaaacttcaagtatatataaararagaaagaactgstgatacacatatcatgaaaaaagaccaaataaaataaaaaaataaaaataaataaataaaataaaatatgtccacaaatgctttgatgttcctttgtttcttgatctgtatgctagcaacacaggttcattccgtttgtgaaaattcattgagctgtgctcttatgagctgtgtacttctctacatgtatgttaaatgtggacaagaacttcacataaaaatcattttaaaaaaa

SEQ ID NO: 3892 - DNA, 796 bp, Homo sapiens
  misc_feature (4)..(4): n equals a,t,g, or c
ggantcctcaggcgttctttagaaggtccgcctgcaggtaccggtccggaattcccgggtcgacccacgcgtycggcagacacaggcacttattcattcatctcattgaaaagctacgagttggttccttattgcctctccataatagaaaaactctttaatgagctctctttttgtttttcaaatcagatatgcaaagaagctcataacaattttttttaaaaatgcaaaacaagaatctccaattatgggagcaaaatcttcagcttctgggttcctgtctcactgaggaaatggatttgaaatggcaaggaggaaatgaggaggcaaactttcatgtctattttagttttccaatgcagtcctatttcctttggactttgtataaacaaggaaaggacagttgttagttcagttattacagataacctgtgtctttaaagtaaatgtatcttaaataagtaggactcccataaatgactacactttttcaaaatatgactccccagcttataacaagaataatagcaaacatcactttattaagcaattactatgtaaaagacacttagtgcttagcacacactggaaatattgttgactggctatattttccccagaaatcccatttctgaaagcctattacaaagaaataaaatcatcagtataacaaaggagtgtgtgtgtgtgtgggtgtgagtgtgtgtgggtgtgagtgtgtggggggtgtgagtgtgtgtggggtgtgagagtgtgtgtgtgagtgtaagtgtgtgtgtgtgtaagtgcacacacg

SEQ ID NO: 3893 - DNA, 1037 bp, Homo sapiens
  misc_feature (12)..(12): n equals a,t,g, or c
tcgacccacgcntccggataggcacaggacaggagtaggcacctcgcctactgctgcttaacctttcagcttctccaggcccccaatcctgcttgcacccagcttgggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaagcctggccgctgggccaggcgggctgcaaggcggtgtactacgtgtgcgcgctcagcatgtacgccagcgtgctgctcaccggcctgctcagcctgcagcgctgcctcgcggtcacccgccccttcctggcgcctcggtgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgccttcttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgct

SEQ ID NO: 3894 - DNA, 1410 bp, Homo sapiens
ccgcctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaamtatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaaaaaaaaaaaaaaaagggcggccgc

SEQ ID NO: 3895 - DNA, 1796 bp, Homo sapiens
  misc_feature (417)..(417): n equals a,t,g, or c
tcgacccacgcgtccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctntgtgtttggcattacttttcctttgctgttgatgtttatccatgcatcgttgagacttcggaacctcaagaacaaactggagaataaaatggaaggataggttgaagaaggacaccgatgggcatgtcctggatgcctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcctttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaaaaaaaaaaaaaaaaaaaa

SEQ ID NO: 3896 - DNA, 2136 bp, Homo sapiens
ggggacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatkttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcstttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggttaaaaaaaaaawaaaaaaamwaggggggcccggtwcccag

SEQ ID NO: 3897 - DNA, 1203 bp, Homo sapiens
gatctgtctttttgcttttagcatcctaatgagtatgaaatgctatcttgtggttttgatttgcattcccctgatggcaactgatgctgagtgtcttttcctgtgcttacgggccatgcgtatttctttggagaaaggtctatccaggtcctttgcctatttttaattgagttgtcttttttttttaagttttctgttttcctaaccactagactaccagggatgagyyttctttttattattgagttgggtgagctatttgtatattctagacgccagtcttttatcmsgyatmtgactggtaaaaatgttctccccttctgtggattgttttcagtttcttgttggtgtcctttgagacacaaaactttttaactttgatgatttccaagatacgtattttttttctattgtcacttgtgcttttggtgccatatctagaaaaccattgcctaatccaaggtcaagaagattaatgcctgtgttttcttctaagaacttgtatagttttagttctcacaatggtctttgatccatttcgagtatatttttatatatgatgtgatgtaggggtccagcttcattcttttgcttgtggatctccacttgtcccactgctggattattgagaaaaatatcctttctccacggaattgycttggcatccttgctaaaggcctctgcttcttactggatcttctttcctgggacatggtgtcgttgggaagcttaccttttkttttttttacttagtctgtgtttggttccaccagttttatgctgcctttctactctgttcttgctgtctccctcyttacctgagtcaacggtactgagtcctatctctctctgatgttccccagtcttccttggtgcatgttctagctccacacactagtccttggaggaaggttgagaccaatgatttcctgttatgagtcatgaggaaactgaatcacctagaagtggaataatgtgctcagggtcaccatagcccattagtggaaggaccaggactagacctttagtcttctgaggtccagccccttaggctgtctgtcatcactgtacccaagtgatgtcactaccaaggccaaatgatggtgggctaaattttaattctcaaaagtgtaggaggctaatattgtcttctaagttccaaaagaagatgtaataaaagtctgttaccttaaaaaaaaaaaa

SEQ ID NO: 3898 - DNA, 1144 bp, Homo sapiens
  misc_feature (3)..(3): n equals a,t,g, or c
  misc_feature (10)..(10): n equals a,t,g, or c
  misc_feature (24)..(24): n equals a,t,g, or c
ctntctatanatcatgtaggaaanggtacctgacgtacggtcsgaattcccgggtcgacccacgygtccgccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaaaaaaaaaaaaaaaaaaactcgagggggggcccggtacccaattcgccctaggaa

SEQ ID NO: 3899 - DNA, 1120 bp, Homo sapiens
ggaggagaacgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaaaaaaaaaaaaaaaaaaa

SEQ ID NO: 3900 - DNA, 718 bp, Homo sapiens
  misc_feature (21)..(21): n equals a,t,g, or c
aactagggatcccccgggctncaggaattcgccactggrgccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaaaaaaaaaaaaaaaaaaactcragggggggcccgagtacccaattsgccctagaagaggcga

SEQ ID NO: 3901 - DNA, 824 bp, Homo sapiens
gggacgcgccgtggacccgcgtgcggacggcggggacaggctccggtgctgagcgcctccggtgtccccagcagcactgacccacttgcaggccccggagctgagccgccagccatggccgctccccgcgggagggccgcgccctggacgacggccctgctgctgctcctagcctcgcaggtcctgtctccgggaagctgcgcggacgaggaggaggtccccgaggagtgggtgctcctgcacgtcgtccagggccagataggcgccgggaactacagctacctgcggctgaaccacgagggcaagatagtcctcaggatgcgcagcctcaagggagatgcggatctgtacgtctccgccagcagcctgcaccccagcttcgacgactacgagctgcaatcggccacctgcggcccggacgccgtgtccatccccgcgcacttccggcgcccagtgggcatcggcgtctatggacacccctcccacctggagagcgagttcgagatgaaggtgtactacgacggcacggtcgarcagcacccgttcggcgaggccgcctaccccgccgacgggcagatgccggscagaagcacgctggtgccccggaagacgcctcgcaagargargaatctgttctctggacratattaattagcattttgaaactggtacttgaaattctcttttgagtcgttgaccacactctgggatataaaaccctccatctgtgaagctgattgcagtttgctgtgaaccttgctacttgtacttggttgaagttctaggtacctttagtcaagggatggaaaaataaagccatacgc

SEQ ID NO: 3902 - DNA, 3941 bp, Homo sapiens
aattcggcacgaggtgtgtgtgtatgtatgtatgtatgtccccttaccccatttcattcttggcccatgcttgctcttccttttttaccactgttatttacttatttctatagcatgagtgaacgtcattttgtaacagtcaagaccgtgacgttcggatgccctccctcccctggtaattttaagtgcagtgaaccctttttcctttgtcatttccatgtgtaaccaaatatgtctaaaattcagacaccttcactggaccatgcatgtttttaatctgaaagatcagtagtactcagagtgttcgtgtattttttaagtgactgcaattttttttttgcttgtctgaaaacttatttttcccttttataattttacattttatagtgaatctttctaagtatagattcttttattagacatgcaaagagaataatcacacaactaagttttccacaaacgtttatgtacacgccaatgtatgcatgagacatctttcaattaaaaatgtttaaactgatttttttttaaataccactataccaatgaggataagctgattttttaacttagattttatagctctagttttgcagttttggaaaatagcaggttttaaacaaaattaatatatgagctatttaaaatggtctttttagagtaagtcttacacataatggtcatttgctacttggattttcttgtccaattaatagtgacatttgacattgtatttagtctttccttccattcattaaacaaatcttactgtgcatgtagggagtatagaatgctacatttaatcttacgagatcatgctgtttaccaaattttatgatgaaattaatgctttcttcagtaggcagtcttacattgtaggcagactcctgtcaagttttgtctttcaaaatggtcctcattagcaagttaccaaaagtaaaaatagggcaataaagtaacagaattccttttaaacccatagtaagctcttctggcatgaatttatagccctcttctacccttccagccaaaggtcattccaaatgctatatgtggaatttgtctgaagggtaaggagtccaacaagaaaggaaaggctgaatcacttatacactgctcccaatgtgagaatagtggtaagtattgaaatgtctttttaaaattttaaccaccgtatttattggttcaaaaactagaatttatagtttcaggcagatttcaaccaaagagtcaccaaattaaatacacagggtagcttgtgaggcatagacacagcccatgtgttttcctctacattgtatattcatttctctttggcgatttgacattatagccattctctggaagtcctaaagcaaactagtattttatgtgccatattaagttaaaatttcttatgtgagataccactaatactggttttgatttaggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtaaagattaaaaaaagagcaaacattatctttgggtgatgagactctcccagcactccaaaaggctgcataaacgctatcatgacatgaagagcttgtggactcttatgtgcaaatatgaccaaagctgtgattatacaggtcatgtccaccagcttttcatccctagmcaattccaactaaaggataagtgaaaggccagaatgcccctgctaagttttggaagtatagttctatagaatgagctggtgtttttctactgaaatactaaagtaacaaagcctttatttttatatgttatctatttagaaacaacaaaatgactgctacgtctttatacatttctatagaaatctattatagatttctgtaaattgaggcagcatgacaattccagataactttagaacagagttgaataaatcacagtaattggactaaaacattacacagataattgtgtaattttagaacttacttgcatagttaacactgtataatactcttataaaatatatgcctacaacgaagtttcctgggaatcattaagcaagcaacataattatttttctgtagtaattcagatcaagtatgtagtacaagttatcattgtgctgttaaagttttaaagtgctgtcagcagagtacaccaggacttgaaagaatgctgttaagacacacagctgccagtgagcaggagagaaaaagtcttaaaaaagccaaattccggaatgggttttgaccttttgaagtatgatagtgtttgaatttcaggaaagattgtactttcttaaaggtccgtatcaccgtatggcattgcatctctcccatcccccttgacttgcaatgaattttgcatggcattgattacattgattaagtttacattttttccttaaattaaggaactcatagtgcccttctcaccacaaaatccagagaggaatatcattagtgatagctaaggcagaagagtttagatgggcttaaaattcagtcctgtaaagataatttttcattctatattaacaatttttttcctaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaattatgagcttaaaatctgcagttatttctgttaaaagctacgcttactctcgaaactaactccaggtagagaattcatcttccaaagtattttatagtaaccttggctcactccaaaaattcagtggaaatgtttagtaacttaagatacttaactgtttctccatagccccaaaagttaattttcatgaaacttcctaatctacattgtttccggcctaccataggtagcactgacaaagttatttaataactgaagaattttcataggtatgacaaatggcccactaagatttggtgcagctggatttagagttgtcattattggactggtacaggaacaaactttgtaaatacctgcctgcccaggaaatcctttttgtatagaaaagtaccatcacctacttggggtacaggcatgaggctttagtccaggctcagggaagtgtacgtaaatcatttccaacttgattttagtaactcttgaaaacttacaccaacttcggttagaatctccagagtaaaattacaaagttatcaaccttttgatttgtgtcacagcatgaaaggttgctctattttatataaacctgttactgcaatcatttttagtcaacctgcctaatgaaaatggagtctaaacactttgtgcacagtccttttataggaattatgatctttaaaatactgtgcttgctgcttttcctatttttggggtaactgaggtaacaaaactgcgtatggctttatttttccatcccttgactaaaggtacctagaacttcaaccaagtacaagtagcaaggttcacagcaaactgcaatcagcttcacagatggagggttttatatcccagagtgtggtcaacgactcaaaagagaatttcaagtaccagtttcaaaatgctaattaatatcgtccagagaacagattcctcctcttgcgaggcgtcttccggggcaccagcgtgcttctggccggcatctgcccgtcggcggggtaggcggcctcgccgaacgggtgctgctcgaccgtgccgtggtagtacaccttcatatcgaggtgggtctcccagagaaggaggggacccccccc

SEQ ID NO: 3903 - DNA, 1611 bp, Homo sapiens
  misc_feature (847)..(847): n equals a,t,g, or c
gcctcactggactttcctgtctgctcggcatggacaggcagcccaggagaaggcagcacgtggccgggtgcagggacgtaccacccccacttccccaggggagctggggtcagacgagtcccaggcactccatcctctgcagcaagtcaggttgtgatttactagggggtggtgaatataatggagagacttctggggaggaattcctggctcccgcgtggacttgcagagctcaacaggcagccacgtggctgagtgtccagcaaacatcacataaggctttgggtcctgcaggtggggctgccatgagcagcaagctcagtccagaagaacagttcctctccaggatccacttcctgcgcacttttatgtgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtgatgagcagatgaccaccgccctccagggtcagcgtttggctgtttgtgtgcctgcccacccgnctccctgtgcctgggcctgccctgtgcctgcacacaggagkggctcatggcgtttgccctacacggatgggctgtcctgggagctactggacagtcaccttggtgggaatgccagaggcatgggcattaggtccccccggmcagcctccgttgccacatgggctatttttgwccatcgcgtgggacaacctagtattgggggaaaactcagtccactctaaagaagcatcggcgttttggatggacgaatgctgcttcatgcgactccatgtcaatggactattttattcaactcgggtatttatgagtgtctcctctgtgccagccacgtgtgaaagaagaactccaagttactggacaccaggacaaaccaggagtctcgctgtgtcacccaggctggagtgcagtggtgtgatcttggcttactgcaacctctgcctcccaggttcaagtgattctcctgcctcagcctcccaagtacctgggactacagatctttagataagcactctttcaaccaaatgccaatcagaaaatctttgaatccacctgtgagctggaagccccgctgtgctttgtgttgtcctgccttttcggaccaatgtaaatctcacatgtactgattgatgcstacatctccttaaaacgtataaaatcaagctgtaacccaaccaccttgggcatgtgttctgaggacctcttgaggctgtgtcactggtcatgatccttaaccttggcaacataaacttctaaactgattgaaa

SEQ ID NO: 3904 - DNA, 882 bp, Homo sapiens
  misc_feature (847)..(847): n equals a,t,g, or c
  misc_feature (860)..(860): n equals a,t,g, or c
  misc_feature (875)..(875): n equals a,t,g, or c
  misc_feature (877)..(877): n equals a,t,g, or c
  misc_feature (882)..(882): n equals a,t,g, or c
gcctcactggactttcctgtctgctcggcatggacaggcagcccaggagaaggcagcacgtggccgggtgcagggacgtaccacccccacttccccaggggagctggggtcagacgagtcccaggcactccatcctctgcagcaagtcaggttgtgatttactagggggtggtgaatataatggagagacttctggggaggaattcctggctcccgcgtggacttgcagagctcaacaggcagccacgtggctgagtgtccagcaaacatcacataaggctttgggtcctgcaggtggggctgccatgagcagcaagctcagtccagaagaacagttcctctccaggatccacttcctgcgcacttttatgtgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtratgagcagatkaccaccgccctccagggtcagcgtttggctgtttgtgtgcctgcccacccgnctccctgtgcctngggccctgcccttgngncctgn

SEQ ID NO: 3905 - DNA, 232 bp, Homo sapiens
aaaatctttgaatccacctgtgagctggaagccccgctgtgctttgtgttgtcctgccttttcggaccaatgtaaatctcacatgtactgattgatgcstacatctccttaaaacgtataaaatcaagctgtaacccaaccaccttgggcatgtgttctgaggacctcttgaggctgtgtcactggtcatgatccttaaccttggcaacataaacttctaaactgattgaaa

SEQ ID NO: 3906 - DNA, 526 bp, Homo sapiens
  misc_feature (283)..(283): n equals a,t,g, or c
ggggacgtgcacggggccgccctcctggccctgaagctgcgccggcctccctgagcgtttcgctgcggagggaagtccactctcggggagagatgctgatgccggtccacttcctgctgctcctgctgctgctcctggggggccccaggacaggcctcccccacaagttctacaaagccaagcccatcttcagctgcctcaacaccgccctgtctgaggctgagaagggccagtgggaggatgcatccctgctgagcaagaggagcttccactacctgcgcanaagsacgcctcttcgggagaggaggaggagggcaaagagaaaaagactttccccatctctggggccaggggtggarccagaggcacccggtacagatacgtgtcccaagcacagcccaggggaaagccacgccaggacacggccaagagtccccaccgcaccaagttcaccctgtccctcgacgtccccaccaacatcatgaacctcctcttcaacatcgccaaggccaagaactgcgtgccc

SEQ ID NO: 3907 - DNA, 571 bp, Homo sapiens
  misc_feature (460)..(460): n equals a,t,g, or c
  misc_feature (494)..(494): n equals a,t,g, or c
  misc_feature (562)..(562): n equals a,t,g, or c
  misc_feature (566)..(566): n equals a,t,g, or c
gcaacatcgtccttactcctgcatttttctgacgggcatgctcccacgcagcttgcgcaacaccaagcgggcggtcaaactctcggctcaattgttataagatcacataacaaaactttcatcctggagctctctcatgcgccgtttgctgctcgctttgccgtttgccctgctgccactggctgtcgctcatgctcacgaagaccatgaccacgagcacggcagcctcggcgcccatgaacatggcgtcgggcgcctgaatgccgtgctggacggccaggccctggagctggaactggacagcccggccatgaacctggtgggtttcgagcatgtagccaccagcgccgccgacaaagccaaggtcgccgccgtgcgcaaacagctggaaaatccatcgggccctgttcaacctgcccaaagccgcagttgtgtggtcagcaaccaaggaatcaacagncgttgttcgtgacaaaccggaagccgagcatgangacgatgaccaagcctccgacgggaaaaggcggcggcggcccacaaagcatgatcaagaccaaaatgnaatncacgc

SEQ ID NO: 3908 - DNA, 1145 bp, Homo sapiens
  misc_feature (9)..(9): n equals a,t,g, or c
  misc_feature (410)..(410): n equals a,t,g, or c
caggcagangggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccnttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggasatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttargtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttatttgtggcttcggggttatatttattactactactactaataaatattcaacaagtaaataaatcttttttaaatca

SEQ ID NO: 3909 - DNA, 2190 bp, Homo sapiens
tcgacccacgcgtccgggcctgcctctccactcagagggacatcagctcaagagcaatcacacaaccccagagaagaaatccaaacctcaccttctgttgctgcttctctactatcttatgggtgcttgactggctctcccaagcctgctgtcctgcagcctcactgcctgtgtccttttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcttccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgatgagggatgagggggaggagagaggtaggagctggagatgaagaggctgctagaagcagcaggaagcctgcccttctgccctctcccttccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttggtccaaaaaaaaaaaaaaaaaaaaaaaaaaaaaaaa

SEQ ID NO: 3910 - DNA, 3302 bp, Homo sapiens
  misc_feature (3274)..(3274): n equals a,t,g, or c
tcgacccacgcgtccgcgacccacgcgtccggggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcayggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagagktgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcacyccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattatnaaaaaaaaaaaaaaaaaaaaaaaaaaaa

SEQ ID NO: 3911 - DNA, 1441 bp, Homo sapiens
acagaaggggagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgagctttgaaggaagaggtccctagctctgttccccctgagcctcttggggagtgggcaacatggtcccaatgactggggcggggaggggggaaggatccctaggctgagagtctagcctaggctgggagtctagcctgcacctgacttgctttatgacctcactgggcttcagtgtctcgtctgtacctcgagtagactgaggtcatggtctctgatgctctggttcctccccaggtgaaggctttcgtcacgcaggacattccattctagtatccttctgttctgggggaggggaaatgggatgggcacctgggagaatctccacgtaacttcagaaaggggtggcagatggttttcaactgacaagttgaattgattggtagtggctcccagaggattctgaggtggtctccatgttgggtgggcaagagagattgactagtgatgactgccacagaatggagaggagggccctttacttctttgaaccctaattttctcacgtataagcggagaccctggcccctcccgggcacagagtaagctctgagcaaaggaggcaatgctgttcccatcagtaaggctgcggaaaccaccacctccctctgcccaccaccccgctccttaacaccacctccagtcacaacctggtgatgaaacacctccctggggccgaccctgagctcgtgctgctgggccgccgctacgaggaactagaggtgaggccgtgggaggtgggctgggggcgaggccagaggcgaggcccagcctgctgaccccgcccctcctccgcctcagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaaaaaaaaaaaaaaaaaaaaaaaaaaaaaaaaaaaaaaaaagggcggccgc

SEQ ID NO: 3912 - DNA, 539 bp, Homo sapiens
gacctcctacatttatgagcaaagctcggtttccctttttgctttccctccgctggttctctgcttagaacactcacaggcatccttgggaaccagactccctgtggtcacaccatcctcactcccctcctcctgcaaggaataggatgtggtttcctggagcttggatagaaagaacaggaagggcgttttcatatgcccggcattaaggctttgaagttcttaaaaccccttctagggtgaaaccgttagggaatttcaacgacgtactagaattattgaacaaatgcaatgggaggatcttgccttgatcctgaagcaacaaatacactttaaaatgacgttttagagggaaatgggggaaattgaatatggactgggaactaaatgattgaaagtagttttgttaatcttgttggtataatattttgtagttctgtttttaaactgctgtcagtgtttatggccagagtctaaatgtttacgagttgctttgcttttaaaatattccaacaaaaaaaaaaaaaaagggcggcgct

SEQ ID NO: 3913 - DNA, 1186 bp, Homo sapiens
gaattcggcacgagattgaatgttccagataatccctttcccagtcctgcctgacatctgggtagggggtttgtccctggaattctgggacactggctggggtttgaggagagaagccagtacctacctggctgcaggatgaagctggccagtggcttcttggttttgtggctcagccttgggggtggcctggctcagagcgacacgagccctgacacggaggagtcctattcagactggggccttcggcacctccggggaagctttgaatccgtcaatagctacttcgattcttttctggagctgctgggagggaagaatggagtctgtcagtacaggtgccgatatggaaaggcaccaatgcccagacctggctacaagccccaagagcccaatggctgcggctcctatttcctgggtctcaaggtaccagaaagtatggacttgggcattccagcaatgacaaagtgctgcaaccagctggatgtctgttatgacacttgcggtgccaacaaatatcgctgtgatgcaaaattccgatggtgtctccamtcgatctgctctgaccttaagcggagtctgggctttgtctccaaagtggaagcctgtgattccctggttgacactgtgttcaacaccgtgtggaccttgggctgccgcccctttatgaatagtcagcgggcagcttgcatctgtgcagaggaggagaaggaagagttatgaggaagaagtgattccttcctggttttgagtgacaccacagctgtcagccttcaagatgtcaagtcttcgartcagcgtgactcattcgttcttccaacagtttggacaccacaaagcaggagaaagggaacatttttctacagctggaaagtgagtcctatcctttgaggaaatttgaaaaaagacatggagtggtttgaaagctactcttcatttaagactgctctccccaaccaagacacatttgcctggaaattcagttcttagcttaaagactaaaatgcaagcaaaccctgcaattcctggacctgatagttatattcatgagtgaaattgtggggagtccagccatttgggaggcaatgactttctgctggcccatgtttcagttgccagtaagcttctcacatttaataaagtgtactttttagaacatttggaaaaaaaaaaaaaaaaaactcga

SEQ ID NO: 3914 - DNA, 1347 bp, Homo sapiens
ggcacgagctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcagctgaagaggtccagcagcagcagacggtatgaccatcaaggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccaggtatggaccatgtatgtatactgattaattaaagaatgctagcatgaagttaattttttcacatgtgaaatatggaaaaatacattgatttgtgaaaaatatatttaaattagtataaaatatttaatttttctaggacctgttaatgaattttaacaataatctgaggtgatatattttgactatttttgacatatacaacctgcttatgtggtattttttactattaataaagctaaatatcaaaccttctgtttagctcttagttgacatgaatttatagaccaaggtaaaggttaacacactacattgttataacctatattaacaaagaattaatactctctatgtaatatttttagcagaattattttgttgaaaagtgccaagtgtttgtttcctctttgttcttcccctttttgttgtaaaattgtttcactttgtagcaaatgatgaaaacattattattttctaagtgttatgcaaatctttataatatcagtatacattaaatatctacctatttagtattctttctctagtaagagcttaccttctgtgcattctgaaatgtacaactttttatgtacaaaaatgtctgttttagcattatgaggaaatgaatgcctatacagtggtctccccttatctatgttcttgtgttccacagtttagttacctgcagtctgaaaatattaagtggaaaattccaaaaataaactacttataggttttaaaaaaaaaaaaaaaaaa

SEQ ID NO: 3915 - DNA, 1264 bp, Homo sapiens
tgggctggaacgcgccggaatctgaggtgtgagtagagcctgggggagagtggatccaggtgaagggggcagaggactgggagttttcrtcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcattttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaawacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacmtgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataataaaaaaaaaaaaaaaaaaaaactcgag

SEQ ID NO: 3916 - DNA, 1007 bp, Homo sapiens
  misc_feature (922)..(922): n equals a,t,g, or c
aattcggcacgaggaaaaaataccatttgtgtatgatacccaatttggatctcaatttggatagagatttggtgcttccagatgtragttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttncgcaagcgcccaccgatccggargctgcgggcagccgttatcccgtggtttaataaagtgccgcgcgctcaccaaaaaaaaaaaa

SEQ ID NO: 3917 - DNA, 733 bp, Homo sapiens
  misc_feature (652)..(652): n equals a,t,g, or c
  misc_feature (675)..(675): n equals a,t,g, or c
  misc_feature (685)..(685): n equals a,t,g, or c
  misc_feature (704)..(704): n equals a,t,g, or c
  misc_feature (719)..(719): n equals a,t,g, or c
ggcacagcaaaaggggcttctattgtattggtcatattttattttggtttaaaaaattttagagtaaatgtggcaaaatgttaatgcttgttaaatctgagtggagagtacattggtgttaagtgtgctgctatgcagggtgagtgaattactcaataactaaataattgtgacataatatatttatttatgcttccctgttatgatctacacataaaattactggagcattattgcttaacttcttgtaaaaaagttctgcaattgtagtgttattaagaaagtaatattgatttgtatagtgacagaggattttttcagtgkcactttgccagcagagatcttcatggtgggcattgsccctgcccatgtctcacttggccctgggcttgccccactaggtaccctgcccacctggccaggcaggctgtgcttggcttgagctctggcccagatcctgcacttgctctgcggcttgagccaggcatgccatgacctacttccaccttgggagccgcgtctggatgaggggaatgctgtgacacttgaacagaaggtggcatgtgaccccaaagcccaaaagggggtggtacagcatgctacagtcttcagctacatcacagccacaatggagtgttgtgccaaagtcctntccatgttgcagcagaaggtgtntcaggtacanttgttgactgccgtggggnctgagtctttccatnccagataagtggct

SEQ ID NO: 3918 - DNA, 741 bp, Homo sapiens
  misc_feature (44)..(44): n equals a,t,g, or c
  misc_feature (69)..(69): n equals a,t,g, or c
  misc_feature (79)..(79): n equals a,t,g, or c
gtatagttgaccaagagggatttttttcagtgtcactttgcccnagcagaagatttttcaatggtgggncattgccccntgcccaatgtctcacttggcccttgggcttgccccactaggtaccctgccgacctggccaggcaggctgtgcttggcttgagctcttggcccagatccctgcacttgctctgcggctgagccaggcatgccatgacctacttccaccttgggagccggcgtctggatgaggggaatgctgtgacacttgaacagaggtgggcatgtgaccccaaagcccccaaagggggtgttacagcatgctaamagttctttcagtctcacatccacagcccaacaaatggaggtgtgtggtgcccagaggtcccttctcccattgtttggcaagcaggaggggtgtgctacagggttacagctttgtttgcacttgccgtttggtgggtcctgagttcttttcccatgtccaagaataaggttgtgctgacagctagcggttgagtgaggcaaagagttttactcagtaacaaaacagctctcagcagagaaggaagcctgagttggacagcacccttacctgaagttgggtagtcttcccaccacctaaaagtgggtagcccaaagtgtggctgagcctggggcttttatatgctcagaatgggagtgtatgtgctaattggtttgtgagtatgcaaaaaaagctaaaaaaaaaaaaaaaaaactcga

SEQ ID NO: 3919 - DNA, 951 bp, Homo sapiens
ccccccccccgagtttttttttttttttttgcattttattttaaagttttattatgaaaacacacagaatcaamkgtgttatccatgtatttgcaacagcagagaaacagtgacagtggaccatccccataggggacacttatcctttggctaaactaatataaataatggaaatgacacctaatacaataacacggcacataaaaaagattaaattaagagaagggacaggaactgcggagaggagtcctgagtatggaggagatgtgtctcatggagaagcatccgggctcaggtgaccttccctgaagacttcctgtctctgagcagctcagttcagttccaggtcatacacgtactcctggacccaggaytcactgggatcagcacagacttgcttgcttcttttggtttggaataccacagctggctgggagcagaggctgctggtctcatagtaatctaccacaaagttgcgaggaagcttcctcgcggtgtaagaaaagcagcaggcggtgggagggtctgagcccattggtgctgagagcgctggagagcagaaggcagctactagcatgaggagagacaggacagtcacgcagagcttcatggtattggtggaaaagaggttttctcagaggtgaggctgcagaactcagaagcttcagaacccagctgtgtcctgtgctgatactgasttgggaatctctctttatagggactctgaggcctaggacaaatgtgggggcacaggagagtgagtggaatttccatggtagagatgaygtcatgctcctgaagctagctgagtgaggagttcctctcagcttctcttccccagggcgatgtcatcatagaggaaagatgagggaggtgcaggcgagaagaaaagggaagtggtacagccaaaggcagtgaccgagactggggagagagttgcaaaccccagag

SEQ ID NO: 3920 - DNA, 997 bp, Homo sapiens
  misc_feature (855)..(855): n equals a,t,g, or c
  misc_feature (881)..(881): n equals a,t,g, or c
  misc_feature (916)..(916): n equals a,t,g, or c
  misc_feature (957)..(957): n equals a,t,g, or c
attggaagttgttttgcaacctgggcttttatacagaagaatacgaatcacaggtgtgtgagcatctacttaattaatttgcttacagccgatttcctgcttactctggcattaccagtgaaaattgttgttgacttgggtgtggcaccttggaagctgaagatattccactgccaagtaacagcctgcctcatctatatcaatatgtatttatcaattatcttcttagcatttgtcagcattgaccgctgtcttcagctgacacacagctgcaagatctaccgaatacaagaacccggatttgccaaaatgatatcaaccgttgtgtggctaatggtccttcttataatggtgccaaatatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcmcctaaagagaccaaggtyagaaagaaaaattaagangtggaaataatggctaaaagacaggntttttgtggtaccaattctgggctttatgggaccntaaagttattatagcttggaaggtaaaaaaaaaaaaagggngggcgctctagaggttccccgaggggccagcttagggtgc

SEQ ID NO: 3921 - DNA, 1914 bp, Homo sapiens
  misc_feature (1889)..(1889): n equals a,t,g, or c
gtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttagggatgtttcctgtgtcgtatgtgcttttctttctttcatatgatcaattctgttggtattttcagtatctcatttctcaaagctaaagagatatacattctggatacttgggaggggaataaattaaagttttcacactgnaaaaaaaaaaaaaaaaaaaactcga

SEQ ID NO: 3922 - DNA, 556 bp, Homo sapiens; identical to SEQ ID NO: 762
  misc_feature (513)..(513): n equals a,t,g, or c

SEQ ID NO: 3923 - DNA, 452 bp, Homo sapiens
gaattcggcacgaggagcccttggccagctctgagacgctttgtgagaccccaaggtgggtgttctagaaggaagaagctttggcttgcttactggaaccaagacaaaaattccaaataaaattccaaataaaaatgtaaatcgagttttttcctcgattgtcacagagactctggtgaatatgttaagttttcagaaagcgattcttttcctagcaatgggctgcttgccttgcattcctcaaggcctgtcctgtgccttccatcctgcatccttccacaaggctctgagtggctgtaggaccctcatatgacaggaggaggaggctgaccttggccaaggtcacatatcccttcttttatccattcgaaaggctcttgctgttgactgactatgcagcagacatagctgggccctggggagatgtgcaaggcaaacacacccaagagatt

SEQ ID NO: 3924 - DNA, 3095 bp, Homo sapiens
ccacgcgtccgtccttccgcagagaacgtggccagaagtgttgtattaggaagcaagtaagaaagaaaaggaaaaaaaaaagaaatcttgcatttgacacatgaaaaagtaactaaaagcttgcacggagatatattaagcccttgcactaaaaatgctggtactgtttaaattcctcccgttgacttcaagtgggcgctttttatccgtaacattgtatcaccgggtgcaccaccagacgtttttcgcaggagcgaagtcattctctccggcgtctacacttaacttgtatatttgttctagccaatttcagtcacttcagaaactttactgtggcgtaattccagttcttaggtacgcgagcatagagtgaaaaaatagctgtgattgttcttatgtaaaaatcaaagctccaatggaagttaatgaatacctttgtaataatggaatctatttgccctttatttcttaatcttctgttttaaactgctgctattaaaaacacacccatgttattaggtttacggaagttgagctgtcgttcaagttcttggcgtccggaaaggtgtccgtgccatgggcttgtgacccggtcctggatacaccagaaacatcaccttcttgccacctaaaagagaatcgcactcacaaacgctgtcacaaccgtctttatgacatcaatctcccttgttccggttctctttttacaaaaaagaatttacttcattaaacaatttccgtctctagtttaaacagaaggtggaaaaaaatagaccccggtctagactcattttctccagtccacattggaatgggtttaagaatatcctcttccaaacaaaacaagacgatttgtactttgtgtctaagatgtctaagatgaaacgtttaaaactctgattaccacaattttggattttttgttaaaatcaaatgtattttcaaacttactgtgttacaatattatagttaaaaagtacagggagagcagaagccctgatctaagaggtgagtcattgtcctcatgttgctgctaacttgaattgcagaagagaaaatctcagtgccttctgcctggctttttgatggagtttgcttaacacccttcatctttctgtttctctccatgtaactaaatgacgttttaaaaattcagtgctgaggtgtctgggtagcacagcggttgagcctccgatttttggtttcaactcaggtcacgatctcagggtcatgggatcgagccccacaacaggctccacgctcagccgggagtgtgcttaagtttctcgctctgcccctgcccttccccttcccctgctgcgtgcacctatgcactctctctctcaaataaacaaataaatctttaaaaataaataaataaaacacagtgcataccataaaacattaagtaatatgcgttagggaagcatttgagatcatgcatagcttatatatttcaaaaaggatttgttcacatcagtacaatagatagatataaaagaagcaattcttggagcgtctgggtaaagaaggtagtgctccggctcagcaggctttcccgtcaagccactgatctccacccggctctcccgtgttcctcttcaataactgagtgcagtctatgagcagatgctgccttctgccacataaagtatccttaacttttactttgctttgagtttaaaccagcattgaaatgtaaatcacgtcttcctcatgcatgaaattgtgagggaagtcagagaggttctctaagagtttatttagcaatgaggaaacaggacaaagaggaggtagtcccatagtggggagggtgggaggcggggtctgccgggcagcactgggtccagcgtctccctttccctagctttctcccaattttctttaggaaaaatgatgtcatagtgagatttcctataacagaatgtttctaaggttcactgtatggacccagaccccagacggttgtcttataagcgaacttagaacggatgctgggaactaagtacttgagtgttgacttgctcacctgcgtgggacagagggacaagccagcaagcccccatgaagtgacgggcagccccacctgggccctggagagaccgacgcaccctctcagctggggtgcagagaaaggattggtttgggggatagcagtggactgtcagaagaacttacgggatcctattgtaatgtaagctatgaatcaggcttgctgtcctgggactgaggttgtaacccgtgaacgacgcaccaacacaggcagctgatgcgtttgctttggcttccaatttgctaatataaaaatctagacttgtttcatgaaaacaggacatttaaacattctatgaatattctccaaaaatatttggggaaacctatgtacacatttctgttggactgacacctagaaatcaaattgttgtgacagaggatgtgcctatgttcagcttcagtaaatactgccggagagatctctgaatgataaacagttaacggaaaatcgcaccaaaccaggctgttggaggcaacaacccattgggctagtttctggtggcctgctgaaccacgcagccaacactgggcttcagactgcacgggactctctttgtccacctgtcctgtgcctggccccacaccaggatgctggcgattatcaaattcactttactggtgattacctttgagcatatttgctttcacaaatcagttctgtaactttgtgtgcattgggctaaattttacaaactaatcattggttaaaaggaagtggcctaaggtccccagtcttgctgatatcagggcagctgctcctttggggttcctcgtcttccatgggtgaagcatgggagtgaggggccccataggggggtcagcgatgccacacttgggggctgtccctgctcagctatgggcagacctactttttaggtttggtttgaggtcctcaccatcaccactgtccttattcaagtaaactaagtctttggttattttaaaattaatgcaatgaaattatgttttagatcattattaagattattaaaaataaagacaaataaaatcatatatgcatattaaaaaaaaaaaaaaaa

SEQ ID NO: 3925 - DNA, 1395 bp, Homo sapiens
  misc_feature (1338)..(1338): n equals a,t,g, or c
  misc_feature (1382)..(1384): n equals a,t,g, or c
  misc_feature (1390)..(1390): n equals a,t,g, or c
tcgacccacgcgtccgggagccatggcgccgtccgggccgctgctgctggtgctgctcgtgccgctggccgccgcgcggccgggccctacttccgtcccggccggggctgccgcctgcccctgcggggggaccagctgtcggggctggggcgcaggacctacccccggccgcacgagtacctgtccccatctgacctgcccaagagctgggactggcgcaacgtgaacggggtcaactatgccagtgccaccaggaaccagcatatcccccagtactgtggctcctgctgggcccacggcagcaccagtgccatggcggaccggatcaacatcaagagaaagggggcgtggccctccamcctgctgtccgtgcaacamktcytcgaytggcgccaacgcgggytctgtgagggggcaackacctgccggtgtsgacgtacgcccatgagcamggcatcccggacgagacctgcaacaactaccaggctaaggaccaggaatgcaacaagttcaaccagtgtggaacatgcacggaattcaaggagtgccactacatccagaactacacgctctggaaagtgggtgactacggctccctctccggcagggagaagatgatggcggaaatctatgccaacggccccatcagctgcggtatcatggccacggagaagatggtgaactacacgggaggcatctacgcggagtaccaggatcaggcctacataaaccacgtcatttctgtggtcggctggggcgtcagcgacggcacggagtactgggttgtccggaattcgtggggggaaccgtggggggagcacggctggatgaggattgtgaccagcacctataaagacgggcagggcgccagttacaacctcgctgtcgaggacacctgtacgtttggggaccccatcgtttaagggacaggtctccccagaagagcagtgttatcgtgaaccataatcagggggtcctatcgctctgggcactgggttggttccaccatggtctgaagggactggggactggcatcaaacgtgtctgatggctgctcgcggccccgtgcgcccagaagggagaaggggcgcctgtcagcacacagcctgccgcggcgccggccgggagcgcgctcctggggaagagtctgcaatgggacggctgagagccccgggccggccactgccctgcccagtgtctgcctggccaccgtgtgatccgcaaggcccaaacgatgtgactgcaagcttctctgtccctgatttggtgtttcctgtctggcagctgtggtccatgatgtggtgcggaagcccaagcttctcaaagctcttacgttgnctgggattcggtgggggggagtcggggggtggaaggagaaagcnnnccttgnaagat

SEQ ID NO: 3926 - DNA, 270 bp, Homo sapiens
  misc_feature (260)..(260): n equals a,t,g, or c
tgtcagcacacagcctgccgcggcgccgccgggagcgcgctcctggggaagagtctgcaatgggacggctgagagcctcgggccggccactgccctgccccagtgtctgcctggccaccgtgtgatccgcaaggcccaaacgatgtgactgccaagctcctctgtccctgatttggtgtttcctgtctgcagctgtggtccatgatgtggtgcggaagcccaggcttctcaaagctcttacgttgctgggattcggtggnggggartcgg

SEQ ID NO: 3927 - DNA, 2324 bp, Homo sapiens
  misc_feature (15)..(15): n equals a,t,g, or c
  misc_feature (23)..(23): n equals a,t,g, or c
  misc_feature (36)..(36): n equals a,t,g, or c
  misc_feature (92)..(92): n equals a,t,g, or c
  misc_feature (95)..(95): n equals a,t,g, or c
  misc_feature (107)..(107): n equals a,t,g, or c
cgccaaacccgcctnttccccgngcgtttgccgtcntttaaatgccaggatcgatccagccatgataagatccattgatgagtttggccaanccncaacttagaatncagtgaaaaaaatgctttatttgtgaaatttgtgatgctattgctttatttgtaaccmttataagctgcaataaccaagttaccamcamcaattgcattcattttatgtttcaggttcaggggraggtgtggraggttttttaaagcaagtaaamcctctacaaatgtggtatgsctgattatgatcatgamcagactgtgaggactgaggggcctgaaatgagccttgggactgtgaatctaaaatacacaamcaattagaatcactagctcctgtgtataatattttcataaatcatactcagtaagcaaaactctcaagcagcaagcatatgcagytagtttaacmcattatacacttaaaaattttatatttaccttagagctttaaatctctgtaggtagtttgtccaattatgtcacaccacagaagtaaggttccttcacaaagatcccaagctagcttataatacgactcactatagggagagagctatgacgtcgcatgcacgcgtaagcttgggcccctcgagggatcctctagagcggccgccctttttttttttttttcatcttttatttatttattatttttttttactaaggcacatgacgtagaaatattgaggtacaaaatgcaaatttctgcataagatttttaagatattcattttggaaaatgaaggtgaacatcatctcccagaatattcagcttttagcttgttttttcttttggaccagttcaaccagcaacttgtacctagcgatacagtcttccttgctcttggacgggacacatctggctattttgtcccagcggtcagaggatccccttgggtactgctgcaacgccagttccagaagtttctgttgattttgagtccacggctcctctgcagaccgagctctctcttttctcaggctctcctcgtcgctggactcgttttgttctgctatgtcaaagtccttctgccgcttggctctggacttctcctctggctccggcttcgctgtagcctccagcagcctggctggcttccgcctccgaggccgggcatcagtggccccggtctcctgctcaccggagtctccctcctgctcctcctccgctgccaccccctctgcgtcctctcgctgggtgatcatgtcatcgggcaaggtggtggccgttttgatgggcctggaattctgaactgtcgatttgagttcggagagtctaaccattcctggggagcaggtcactgaatccttcagttgcttggctttggttgtcacatctgtcacagatcgacccaattcgtgggcaatcttttcccatcgacctggagtccctcctgggaacttaaccatacttcttgtcagttggctgaggtcctcttctgtccattcaggtgcctgttttttctgtgttcggttcctgttttccaaccaatcatccatttgttcctcaatttcttctatggaagttccatgatcataagactgaatatatgtagtttctaaaggtgtgtatacaggaaattcaggttttggttttttaactttcttctgtttttgaagtgtttcaagttcagttctagtcagtgcatcttccttttccttcaatcttgtttctttatatttagcataaaactgcccagcatcctggatgaggtgaggtaatgcttttagtgtaaggcaaaaccaaatccccagtttgcatggaagcaaatcatgccactgtggtttcatcagcaatctttcatttttttctgaagcaccgagttttgatacatccacactcttgctgccagtcttttttttcttttctctcttttttctacttagtagttcatccagttgtttttccaggtagattgaccaaaccacagcataatgacccactgtgagaataatgaacaagagtaatgccagctcagcattgctcatttttctcacccgcctgtagtagaatacaggctgtcgccaatctggaagtccattgatcagaatatcatcatacctctgccttcgttcatcatcctttaaaacttcataaatggccaccaattgtctaaactgagtttctgcattttcatctttattcttgtctggatgtaaagttagtgaaagcttacgatatgcttttctgatgtctgcagatgatgcatcctgctgcaccccgaggaactggtagaagttgagcggacgcgtgggtcgacccgggaattccggacc

SEQ ID NO: 3928 - DNA, 1540 bp, Homo sapiens
ggcacgagggaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtgggatgtcaacaagccccagggacgcgccccagcctgcctccaggtgcagtacaatgacatttttaaaaatcgcccagcaaaggtctttgaattttatttcatccaagaaaatccacagctctttaagctctagatttgtccaaatttaaaatcctgaagttagagatggtatttcactccttcctctattcccaggacctagctttttttttttaacatacacaatagggatttgataagtttctgatggctgcaggcatgtaagagcatttcagtggtattgaatcaatgaagaattttgttgacatgtgaaatcttataaaaatattctttaccgaaggactgagttatgtggcagtgggcaaattcattgtttcatacctcccctagtaactgggaaaaatatgttaatacatagtctctctgtttttctgcatttggaagctttcagaggaacataatgtagaggtgtttctttagcaaagtgcactgatagcaaacataaggattgcaggtggggcctgagagtcctcatgagatagattctcacagtgattagaagatggagtctcacgtccctgcctgtgaactttctggaaaaaccatcttctccaagctgccattgacaacaatatggataacaataataacaataaggcccaataaactcctttatctcttcttcagggggccatactgacatcttctcttccttggtttcccctccttgccccctaaatatccagtaactcattcaaaataatgtcaccttaccaagagcagcacccctaactttccataatattttcactttcattttccctccaagcagcccactcgtaggaccgtagaattgattcttccacctggagaattttattttctttagcctttttggttttcagtgacaaatcctcttctcgcaaggggtggtttccatagttgtttatatcctgccctcataatttggagaagtgttcacatctgccgtgggatgagactgtatctcttttctttcttttgggtctttctccagatagggacttcttatgcaactcaaggatgggtacatgaaaaataaaattgtactctgagccattactggtgggctatgtttatatggccattttaccatagagttatttacttctttttgtttctatttgtattgaggtgtgattaacaaataaaattgtaaatacttaaggtaaaaaaaaaaaaaaaaaaaaaaaaaaaaa

SEQ ID NO: 3929 - DNA, 1333 bp, Homo sapiens
  misc_feature (485)..(486): n equals a,t,g, or c
  misc_feature (493)..(493): n equals a,t,g, or c
  misc_feature (496)..(496): n equals a,t,g, or c
  misc_feature (587)..(587): n equals a,t,g, or c
  misc_feature (633)..(633): n equals a,t,g, or c
  misc_feature (1330)..(1330): n equals a,t,g, or c
agctggtaccaaagcaagtttttcactgagctctcatgaaagatcctcagtctcttgtggatttagaatcctgcagcagcccaccatctaagagcaagarccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaaggagaagtaggtccaattggtcctcctggaccaaagggagacnnatgatanctntgggacccggggctgcctggagtttgcagatgtggaagcatcgtgctcaaatccgccttttctgttggcatcacaaccagctacccagaanaaagactacctattatatttaacaaggtcctccttccacgaggganagcactacaaccctgccacaggggaagttcatctgtgctttcccaggggatctattacttttcttatgatatcacattggctaataagcatctggcaatcggactggtacacaatgggcaataccggataaagaccttcgacgccaacacaggaaaccatgatgtggcttcggggtccacagtcatctatctgcagccagaagatgaagtctggctggagattttcttcacagaccagaatggcctcttctcagacccaggttgggcagacagcttattctccgggtttctcttatacgttgacacagattacctagattccatatcagaagatgatgaattgtgatcaggaccaagatccctgtggtaaacactctgattgaatctggggttccagaaggtggaacaagcaggaatgggatccaaagagactcccactcagattctaaagcatttaaagacaattctagcagaatttatcaaaacaagatgaaacacagaaaagttgaaaccacaacaaaatgaattctattaaagaatagccccagatataaattctcttgaaagcaatgttcataaatatttaagcaaattaaagacaatgttaacaaattttctattaaatgccctgagtgataaaaccagttggcaataatattgccttattaaatcttcaaaaaataaaaaaaattaaaanaaa

SEQ ID NO: 3930 - DNA, 745 bp, Homo sapiens
  misc_feature (312)..(312): n equals a,t,g, or c
gtacaggactgagaagcagataacaagagtgacgctcacagggctgggctgacgctaacaggaggcagtgtgtggctcgaagattcttgaacccacagcagcagctgcggccaccccatcctgcccacagctccagccctgagacgacgaggaggagagtcgactttgcctcttgcccaagggaccatgcccaggtgccggtggctctccctgatcctcctcaccattcccctggccctggtggccaggaaagacccaaaaaagaatgagacgggggtgctgaggaaattaaaacccgtcaatgccttcaantgccaacgtggaagcagtgtyygtggttttgccatgcaagaatacaacaaagagagcgaggacaagtatgtcttcctggtggtcaagacactgcaagcccagcttcaggtcacaaatcttctggaataccttattgatgtagaaattgcccgcagcgattgcagaaagcctttaagcactaatgaaatcgcgccattcaagaraactccaagctgaaaaggaaattaagctgcagctttttggtaggagcacttccctggaatggtgaattcactgtgatggagaaaaagtgtgaagatgcttaatggtgttttgaggcatccctccaacctctgtgactactttatccatgaaaatgaagcaatggtcaggtgggaggctcttcccaatgtgctttcttcaaaaaaaaaaaaaaaaaaaaaaaaaaactcga

SEQ ID NO: 3931 - DNA, 408 bp, Homo sapiens
  misc_feature (350)..(350): n equals a,t,g, or c
  misc_feature (376)..(376): n equals a,t,g, or c
  misc_feature (386)..(386): n equals a,t,g, or c
  misc_feature (404)..(404): n equals a,t,g, or c
gatctacctggaatgaacaagaatgaacgccagcctcatttcatgggttttggttctccacaggatctgcctcggtctgtcagacattcctaaggaaaattgtataataactatttcgggaatgcagttatctcatcatggtcagtctttggggaagtgggctgagaaattacatgtgttctattctctattttcattcctattgtgaccttcacaccgactcaaaaccttccttttagatacttctggatataaaaatatatgttaattttggggtttcacactcctgagtgaaaggcagtgtcatcaagtacgtgaatgcccagctcctaaatgtctttctcgttctnctcccacccagtcacgtcctccaagnagtgaacttnctttaattcacaatccgnttac

SEQ ID NO: 3932 - DNA, 1299 bp, Homo sapiens
  misc_feature (1291)..(1291): n equals a,t,g, or c
atccaaagaattcggcacgagcgaagatggcggcggcgacaggaggcgctgagggagttcgtggcggtgacgggcgccgaggaggaccgggcccgcttctttctcgagtcggccggctgggacttgcagtgataatagagtgacatccttcaragacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatgccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaggggggcccggtcccaatncccccctt

SEQ ID NO: 3933 - DNA, 1669 bp, Homo sapiens
  misc_feature (4)..(4): n equals a,t,g, or c
  misc_feature (54)..(54): n equals a,t,g, or c
  misc_feature (1424)..(1424): n equals a,t,g, or c
  misc_feature (1663)..(1663): n equals a,t,g, or c
gctnctaaatgtctttctcgttctcctcccacccagtcacgtcctccaggcagngaccttcctttatttcacattccgcttacttccttgacccctcagcatttcagacctgaaaggacactggtactgwtgtccttgtcggggcctgtggctttgcctctcattccctggtgaatgtcaggaaatagagggctgagactaatttttataggctctcaatttttcttgcwtggggacaagctgttgacttagctctgaataggagtaataaggaggcagtgggccaggctgcatgacaactggttttcaggcccatataaaaaagtactaactttattatctcaagccatgcctggcctattgcaaagcccagtgtgggtgtcttggggcttgtatttgagattggagcttctctgacctccagtaccctttcctcaggggccacagtgtgtgtcacatgaatggcaaggtgaggtgaggcttgggggagctcctggtgctgtgtcacaccaccttacctgtgtgcattactctgtgcttgttcttttgcatacatctgctgatttgaacctcacggctctgacttaagagcagtaggtagggcatgtggtccttccctcccgtttcaaagacaaggaaagtgagtcacagagtagtgcactggcttacccaggacatacagtggcagagccaagactggagcctagctgcttgtactaaccatgccagtgccaccattaaccccaagtcactagtggtagctacttctgactatgactgtagtcactgtctcctggagaggagcctggccaccagattgatagtcccagctgagactctctcctgaactgataagctgttttgcatgcttggaatgcctttccccagtttgttcacctgataaactcatccttatcctcaagattcagcccagaagacacccttaaaggaagccttggctgtccttcccacccagtgttccctcactgacttctgttgctgctcacactgcattttacctgcttgcctccttccatgtgttcccagctagccagtaaattctttaaagacaagcattgtaccctttgcctcagtgtgcccagcaccaacctggcacatgctctattcatgttttccatgagtgtttcatgttagaggtgtattttgtacacaggttttatgctgggggctcagagagaagtggacagcagattgttggcccwcccaggaagaaaagtcccaacgagctggtggatgatctctttaaaggtgccaaagagcatggagctgtagctgtggagcgagtgacaaagagctggctgatgagagccagaccctgaaggaagccaacctgctcaatgctgtcatcgtgcagcggttaacataaccgcccagccagctgcctggcctccctcctgtgtttncccatggccagtggccatgccccatggggatcgcccctcctgcccccttgtgcayacccagcagtccagtgcaacgtctcctccatagctctgggttcttagatcttggttggacgtttgttttctccttagttgcatttcctgggtttttgtgatgatcaatggactttaatgaaaaaaaaaaaaaaamaaccaaaaaaattgaaaaaaaaaaaaaaaaaaaaaaaaaaaaggggggncccttt

SEQ ID NO: 3934 - DNA, 530 bp, Homo sapiens
  misc_feature (517)..(517): n equals a,t,g, or c
gcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaagcctcctgggattcattcctgntgcctggaatctt

SEQ ID NO: 3935 - DNA, 1046 bp, Homo sapiens
  misc_feature (14)..(14): n equals a,t,g, or c
  misc_feature (33)..(33): n equals a,t,g, or c
  misc_feature (441)..(441): n equals a,t,g, or c
  misc_feature (460)..(460): n equals a,t,g, or c
gagaagtcagcctngcagagagactctgaaatnagggattagaggtgttcaaggagcaagagcttcagcctgcaagacaagggagcagtccctgaagacgcttctactcaccactggtgcctgacagcatgaaatttgagattggagaggctctttacttgggcattatttcttccctgttctccctgatakctggaatcatcctctgcttttcctgctcatsccagagaaatcgctccaactactacgatgcctaccaagcccaacctcttgccacaaggagctctccaaggcctggtcaacctcccaaagtcaagagtgagttcaattcctacagcytgacagggtatgtgtgaagaaccaggggccagarctgggggktggctgggtctgtgaaaaacagtggacagcaccccgaggccacaggtgagggacattacnactggatcgtgtcagaagntgctgctgaggatagactgactttggccattggattgagcaaaggcagaaatgggggctagtgtaacagcatgcaggttgaattgccaaggatgctcgccatgccagcctttctgttttcctcaccttgctgstcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaaaaaaaaaaaaaactcgagggggggcccggtac

SEQ ID NO: 3936 - DNA, 1657 bp, Homo sapiens
  misc_feature (1523)..(1523): n equals a,t,g, or c
  misc_feature (1608)..(1608): n equals a,t,g, or c
  misc_feature (1650)..(1650): n equals a,t,g, or c
agtctggagccggcgcgkaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcrtatttttaaaatttgaatctatttgagctttagttcagcagaattaaatttttacttgacattatcattaaaawtgctaggtatggagaacaattcctrttttattttgaacactgagaaagaggtaaacttttcctaaaacactttatattataaaycgaaaaataaattgctagnttatattttaagatattaacatcatattttttaataatacctacatcaaatgggaaaatatctgaaatttttttttcattagcanggatttttctactagaaagtagtttaactactttcattttanaaccaga

SEQ ID NO: 3937 - DNA, 1305 bp, Homo sapiens
cgaacactgagaagagtaaacttttcctaaaacactttatattataaacgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactacttttttyggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagcaccaaaaaaaaaaaaaaaaaaaaaaaaaactc

SEQ ID NO: 3938 - DNA, 1180 bp, Homo sapiens
  misc_feature (29)..(30): n equals a,t,g, or c
  misc_feature (32)..(32): n equals a,t,g, or c
ccgttttgaaggtcctagcccacctggtnngnctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgaraktttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagt

SEQ ID NO: 3939 - DNA, 1293 bp, Homo sapiens
  misc_feature (184)..(184): n equals a,t,g, or c
  misc_feature (208)..(208): n equals a,t,g, or c
gccgccgggggacgcggacccaaacgccgctcaccgcttgcggcgccgggcatggggagtgtggtgtgagcccgcacccggggaggacgcaggagctgcggagacgggcgcgaggaggaggagaggagtcgtggattggaaggacccgagggagggagggtggggaagcgagggaaaagtgaanctgggaggagaaggcggcggaagntggagattgatgcttctgttttttgttgccgctgctgccctcgcgctgggagccgagccggagggaaggcggtggagagatgattgcagagttggtgagcagcgctctggggctcgccttgtatctcaacaccctgagtgcggatttctgctatgatgacagccgtgctatcaagactaatcaggaccttctcccagaaactccatggacgcacattttctacaatgatttttgggggactcttctaacccacagtggcagccacaagtcctaccggccactctgcactctttcttttcgcctgaaccatgccattggagggttgaatccctggagctaccatcttgtcaatgtcctgttgcatgcagcagtcactggtctcttcacaagcttctccaagatcctccttggtgatggatactggacattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaaaggaagaacttgtcgcttttcctaagcattagtttgttaattttctggggttcctcccttttgggtgcccggttatactggatgggaaacaaaccaccaagcttttccaactcggacaaccccgctgctgattcggacagcctcctcacccgcactctcaccttcttctacttgccaaccaagaacctctggctgttgctawgtccagataccctcagttttgaatggtcaatggatgctgtgcctctgctcaaaacagtttgtgactggagaaacctacacactgtgggccttctawaatgggactccttctccttggcctaactaagggtttgaaraagcccgaggcgtt

SEQ ID NO: 3940 - DNA, 733 bp, Homo sapiens
tgtgaccgatatctgcaraattcggcttatcgygaacctggctttggyggacctgggactggcactcactctccccttttgggcagccgagtcggcactggactttcactggcccttcggaggtgccctctgcaagatggttctgacggccactgtcctcaacgtctatgccagcatcttcctcatcacagcgctgagcgttgctcgctactgggtggtggccatggctgcggggccaggcacccacctctcactcttctgggcccgaatagccaccctggcagtgtgggcggcggctgccctggtgacggtgcccacagctgtcttcggggtggarggtgargtgtgtggtgtgcgcctttgcctgctgcgtttccccagcaggtactggctgggggcctaccagctgcagagggtggtgctggctttcatggtgcccttgggcgtcatcaccaccagctacctgctgctgctggccttcctgcagcggcggcaacggcggcggcaggacagcagggtcgtggcccgctctgtccgcatcctggtggcttccttcttcctctgctggtttcccaaccatgtggtcactctctggggtgtcctggtgaagtttgacctggtgccctggaacagtactttctatactatccagacgtatgtcttccctgtcactacttgcttggcacacagcaatagctgcctsaacccawtagcytaygtcttaagcmgaatt

SEQ ID NO: 3941 - DNA, 918 bp, Homo sapiens
  misc_feature (2)..(2): n equals a,t,g, or c
  misc_feature (492)..(492): n equals a,t,g, or c
  misc_feature (776)..(776): n equals a,t,g, or c
  misc_feature (861)..(861): n equals a,t,g, or c
  misc_feature (903)..(903): n equals a,t,g, or c
tngaaaaaaatccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcggcttgccaccaacgagttcatcctsagcctgacagccaagctggatgagaatgaatggggctctgtgaggcatcttgcagctccctcgacaatgctctgcccgtacactctgttctcgtggtttctgtctcctcttctgtgtttacagggttgggcagctgctacagcccttgcctcttccctgagtgcctcagagtgacagagatgaagaagccacttggctctaggaagtgtggcctggctttgatatggtttggctttgtgtccccacctaaatctcatctgggaattgtaatcccccatgtgtnagacggaaggaggtgattggatcatggaggcaktttcccccaagctgttctcatgatagtgagtgagttctcacgagatctgatggttttataagtgtatggaaagctcctcctttactcactcttctctctcttgctgccttgtgaagaaggtgactgcttccccttctgccatgattatgagtttcctgaggcctcccctgccatgcggaactgtaagtccattaaagctcctttgtttataaattacccagtytcaggtatttctttatagcagtgtaagnatgaactaatacagtgtgagaactaatacaggcacaggatgaacacgttggtgacaagccgaattctgcagatatccatcacacnggcggccgctcgagcatgcatctagagggcccaattcgccanatggtgatcgtatta

SEQ ID NO: 3942 - DNA, 1395 bp, Homo sapiens
gaattccccgggcccggggaatccccgggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaaaaaaaaaaaaaaaaaaaaaaaaaaaaaaaaaaaaaaaaaaaaaactcga

SEQ ID NO: 3943 - DNA, 1918 bp, Homo sapiens
  misc_feature (1719)..(1719): n equals a,t,g, or c
  misc_feature (1800)..(1800): n equals a,t,g, or c
gggcggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctatnaatcccagaggctgaggcaggcggatcacctgaggttcaggagttcrrgatcagcctgaccaacatggrgaaaccctactngaaaatacaaagttagccaggcatggtggtgcatgcctgtratcccagctgctcaggagcctggcaacaagagcaaaactccagctcaaaaaaaaaaaaaaaaaaaaaaaaaactcga

SEQ ID NO: 3944 - DNA, 675 bp, Homo sapiens
ggcacgagctccaggctgtgcttctctggagcccgcgaggggcacctgcccagcctgctggccatgatccacgtcagacactgcacccccatccccgccctcctcgtctgttgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcaaggtgaaccttctcatccccgtggcgtacttggtcttctgggccttcctgctggtcttcagcttcatctcagagcctatggtctgtggggtcggcgtcatcatcatccttacgggggtgcccattttctttctgggagtgttctggagaagcaaaccaaagtgtgtgcacagactcacagagtccatgacacactggggccaggagctgtgtttcgtggtctacccccaggacgcccccgaagaggaggaagaatggcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaaaaa

SEQ ID NO: 3945 - DNA, 1669 bp, Homo sapiens
gctccaggctgtgcttctctggagcccgcragggscacctgcccagcctgctggccatgatccacgtcagacactgcacccccatccccgccctcctcgtctgttgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcamggtgaaccttctcatccccgtggcgtacttggtcttctgggccttcctgctggtcttcagcttcatctcagagcctatggtctgtggggtcggcgtcatcatcayycttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatgcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaagaaaaaagatacgactctcagaagcctgttttaaggaagccctaaaatgtggactgggtttcctgtcttagcactgccctgctagctcttcctgaaaaggcctataaataaacagggctggctgttcgctcgtgctatggggagtccctgatgggcacagacgggagtggctggggcgtacctcggtgggtgcacacatgttgctggccaggaagatgccgtggcaggccctggaggaggctcttgacattagggggctttgctgcttgacacaggcgctccctaccatggcacccagagtccccctgccctaaagggatgtcgaggatggggtagcagctcagtccgcccctaccccaggcccctcgatgccagtctgagctcggccacccaggagagctcaggggctccaggctgggattgtctttcttcccgtaaatcaccacagagtgaaggtcaggacttcagagcccacagtctcaccctggcttacaggtggggaaaccgaggccctgagataggatggaacagacgtggccactgctgttggtgcctcggcctctctgtccccagaaagcacagagcagcatgtcctgggggctttgaggcctgcagggaactccaggggcttcatgtacagcaggcacacaccccagcccttccacggtrcccaggagattggaccttcagggagggcaaagggcgcctgcctggccaggggcatgagggtttggcaggagccacccaacccaggtcctccagaggccttgctggacaggaagagggtgaggcgtgagcaaaatagtcaccacggatgagacccagcgtccccatggcccggccccatcctcatgacaactcccagctctaggggcagctgttgccactgcagggcagatgaagcaaaaaggctctggtcccctgcttctctggaaatgggttcccagaatggagtggggggagagaagtgagaccccagggtgcttgtgtacaatgggaccctgca

SEQ ID NO: 3946 - DNA, 2410 bp, Homo sapiens
ggcacgaggagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctgggctgctggtctcttctccttggcctgagctccctttctctgccggcagccatctcagccctgcagttgtctgttttcagaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtcgtacctctctgaagccttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaaaaaaaaaaaaaaaaaaa

SEQ ID NO: 3947 - DNA, 1836 bp, Homo sapiens
  misc_feature (358)..(358): n equals a,t,g, or c
  misc_feature (1799)..(1799): n equals a,t,g, or c
agagcctcctgggttctttagaggtttggcccctggggagagtgggaggagcaggggtctgaggagcagggktctggcagagcaggggtctgaggagcaggggtctggcccacccgggctcgggacagcctctgtttagctgcattctcccgtctgcctggcagccacttgtccgcagtgcagtctggccccagcggcaggtcacaggacggggcagggagagccatggcagcccgtgggcgttctggagtggggccacctggcttcttgcgggccttggcgctgctccagctttcctgtgggttctactgggcctgcagtaggggctggatggtccgaggaactccccacccttgancctgggcactggcccagctgtggtcagtaccagtttcctgtagatgctgccgcacagacagmcagaggccccggggtccggccgcccatgcatagccccagaggggacagattctggcgaccagagttgctgggcagtcttgggtttagtgccgcaatgctgcacttctgacaggytgyttmskggatccctgcagggacctggccagggcattggccccaggtcacctgtggctttggggagagcagttgcagggctggcctgggctgtgggaggcagctgtgccgttttctgacagccattgggaccgccccagtacccgaagaggtggctgccctgagttgccacgggaaactgcagggtggccctggctcagcagccaaccttggggagacctggaggaacagtgcagtgtaaagatggcctcgcgctgagcgggtccccgcagtcggcactcccaggagaaccagcgggctgtgcatgtgacccgccagcctgcaccgcgggcacgtccttcccacccagaggaccctgcactgccttcagggccacagcagtcctccggggcccagcctcaggcaggaaacagcaaatgcttttgctgccaaccaagtgtggctgtcgctttcgatgatgccagtggcgctggtgcgactgccgggcagcatgtgtgggcggggatggctcggccactgaccgtctycccgcagtggtggtcctgctycatgatgtccgtgatgtgagcgtggaggaggagaaggtccggtacttcgggaaaggctacatggtggtgctycggcttgcgacgggcttctcccaccccctcacgcaragtgcagtcatgggccaccgcaggtaaggctgtgggactttgatctggccggagctgcagccgtagcaggtcactcccgttcctgactgcccagagctatggggcagctgggagaggagatgagtttgtggacgggacacagaggggcccacgggaagcgtgtgcaggctcaggggcagccccactgtgacggggaggctgggagcaggccaggaagtgctgggtccagtttgggagctccagggtctgcgggaggtaggtggtcgaggaggagactgctgtggggyctcacggtgccctatgccgaggtgacctgaccttcctcccgttgccggcctcgyccagtgatgtggaagccatcgccaagctcatcaccagcttcctggagctgcactgccttgagagccccacagagctgtctcagagcagcgacagtgaggccggtgaccctgcaagccagagctgacagscccactgtgcctgarcccgtgcaccgcccacaggacccatggcacattcccggtgtgcctgagcccgtgcaccgcccacaggacccgtggcacattcccggtgtgcctgagcccgtgcaccgcccacaggacccgtggnacattcccggtgtgcctgagcccgtgcaccgccacag

SEQ ID NO: 3948 - DNA, 1542 bp, Homo sapiens
  misc_feature (1449)..(1449): n equals a,t,g, or c
  misc_feature (1490)..(1490): n equals a,t,g, or c
  misc_feature (1500)..(1500): n equals a,t,g, or c
  misc_feature (1520)..(1520): n equals a,t,g, or c
tcgacccacgcgtccgccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgyccacaggacccrtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcacttttcggagggccgaggttgggaggatttgctttnagggccagggggtttcaaggaccaggcctgggggaaaacanaggcaaggtncctgtttttttgttaaaaanaaaattaaacccaaaacaggga

SEQ ID NO: 3949 - DNA, 524 bp, Homo sapiens
  misc_feature (6)..(6): n equals a,t,g, or c
ttacgncaagatcctgtytttgtaaaaraactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtcaaaaaaaaaaaaaaaaaaaaaaaaaaaaaaaaaaaaaaaaaaaaaaaaaaagg

SEQ ID NO: 3950 - DNA, 1621 bp, Homo sapiens
  misc_feature (1596)..(1596): n equals a,t,g, or c
  misc_feature (1607)..(1607): n equals a,t,g, or c
  misc_feature (1616)..(1616): n equals a,t,g, or c
gggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggraaaagaacggtcacttacctggacactatggccatagtcttgagtttttctagtcagcatgtgattggttgtaccttaagtttatgmcaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcwgtttggaaggcaggccaagggagatccccaaagacagttatcagtcttaacttcygctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggktggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattktcatcaagggtcatatttcaataaaaggtgctaaggacaaaaaaaaaaaaaaaaaaaaaaaaaaaaaaaaaaaaaaaaaaaaaaaaaaaaaaaaaaaaaaaaaaaagggcggccgttttanaggatccaagnttacgtacncgtgc

SEQ ID NO: 3951 - DNA, 830 bp, Homo sapiens
ggtcgacccacgcgtccgctgaaaggaaaagcactgtttggagaatgatccacctttcaagattttacttattgttgataatgctcccacatgtcctcttttttacgggtgatcttcattcctaatatcaaagtgatatttcttcctccaggcaccacctctttgatccacacaatggatcaaggagttatagcagcttttaagttctactacctgagaagggaggacttttgcccagtcccatactgcagtggaggaagacactgagaagactctgatgaaattctgaacagcatcaagaaccttgtttaggcttggattatgtcgctaaggactgtaggaatggcacctggaagaagacacgcaagaggtttgtcaataacttcaaaggatttgccaaggatgaggaagttgcaaaaatcaagaaggctgtggttgagatggcaaacaactttaacctgggtgtggatgtggatgacattgagtaattcctagagggggttcctgaggaattgactaatgggttgctgttggaactggaataggagtgcatagctgaagaagaggtaaagaaaaagaaagtgcaggagaagggaaaaaagaactcccaagaatactcacagtgatgggtttagcagaagcttcttcagactccaacaagctccttaagaagtctgaaaacatggaccccaaaactgaaaggttttcactaatagagaggaaagttcatggtgcattatctgcctacaagcaaaaccaggattcaaaaaaccctttgagctggagcttcaaagcacaaaaaaaaaaaaaaaaaaaaaaaaagggcggcc

SEQ ID NO: 3952 - DNA, 1569 bp, Homo sapiens
  misc_feature (24)..(24): n equals a,t,g, or c
  misc_feature (1525)..(1525): n equals a,t,g, or c
  misc_feature (1534)..(1534): n equals a,t,g, or c
  misc_feature (1540)..(1540): n equals a,t,g, or c
  misc_feature (1544)..(1544): n equals a,t,g, or c
gctttaatcgcycctataggaaanctggtacgcctgcaggtaccggtccggaattcccgggtcgacccacgcgtccggaaactttgctggatttatttatcaggtctagragctttttgratggtctttaagtttttctagatatataatcctatcatcamcaaacagcgacagtttgacttcctctttttaaattkggatgcactttatttctttcctttatccaattgctctggctacgacttccagtactgtgttgaatagaagtggtgaatgtgggcatccttgtctcgttccagttctcagggagaatgctttcagcctttccccattcggtatgatgtttgctgtgggtttgtcatatatggctttttttactttgaggtatgttccttctgtgccaattttgttgagggtttttatcatacaggaatgttggattttatcgaatgctttttctgcatctggtgagatgatcatatgatttttatttttaattctatttatgtgatatatcacattgacttgggtatgttaaaccatccctgcatccctagtattcaacccacttgatcatgatatattattatctttttgatatgctgttggatttggttagctaatattttgttgaggatttttgcatctgtgttcatcagggatattggtttgtagttttctttttttgagacagctaattctttgttgtgaggggctgtcctgtgcatcatagaatgaccagcagcagcagcactgactgacaaaccaaaaatgtctccagacattgccaaatgtccccttgggggcaaaatttccatctgttaagaaccattggcctaatgcttggcacataataagtgctcaataaatattagcactgtgactgctattattatttttacagtttgagtatcccttacccaaaatgcttgggaccacaagtatttcagattttaggtttttttggattttggaatatttgcattatacgtcccagtttagcatctctaatctgaaatctgaaatgctctaatgagcatttcttttgagtgtcataacagcacacaaaaaaagtttccaattttggagcttttggaattggagatacccaacctgtaccttcttgaattgktgaattttctcccatgkgcatttgktacttttataataataaaaaaatactctcttgattgagatgaaaagtatcaaagaggaaaaagcaattagtcttcatccaggggaacaatgkataacgtgaaaaaataattgcctggcatttattgagtgattaccatgtgctaggtgctgtgctaaacaaaaacatacgttatctaccttaatcttcaacatctccttgagataagcacttctgtgctcctccgcccccatttcacagatgaagaaggtaagtcattgaatagytaggaatatttctcaggaatgtggttgctttggatgcatgttggtctataagaagtaaacatcttatgtacycwatgtgtgtgccgtgtgtgtgcgtgkatgngtgtatggngtgaantggngatgaggtatcactattttacctgg

SEQ ID NO: 3953 - DNA, 387 bp, Homo sapiens
  misc_feature (380)..(380): n equals a,t,g, or c
cgggtcgacccacgcgtccggaaactttgctggatttatttatcaggtctaggagctttttggatggtctttaagtttttctagatatataatcctatcatcaacaaacagcgacagtttgacttcctctttttaaatttggatgcactttatttctttcctttatccaattgctctggctacgacttccagtactgtgttgaatagaagtggtgaatgtgggcatccttgtctcgttccagttctcagggagaatgctttcagcctttccccattcggtatgatgtttgctgtgggtttgtcatatatggctttttttactttgaggtatgttccttctgtgccaattttgttgagggtttttatcatacaggaatgtngatttta

SEQ ID NO: 3954 - DNA, 865 bp, Homo sapiens
  misc_feature (321)..(321): n equals a,t,g, or c
  misc_feature (409)..(409): n equals a,t,g, or c
ggtcgacccacgcgtccggagtagcagaaatttgtcttcttacaagtagtctatgagagtagatgctgattttctaaatgtaagggaataagaaaaacttcatgattaacttttttcacgtgtatttgggctttggtgggagtaggcaagaagaatatccgtggatttatagagtaagcaaaagtatgtcaggaaaaactaggaagaatagggctgaactgtggcttgatttcaggagagtttctgggattcagacttgaattaactgaatgatgctgtaatgtataagtgttggtataggtgattttatgcaaagaagantaaacattggcttacttttattatcgtatacggtatgggtgactactgctgctagttcaaggtctkgattttttaaaaatgtgtttcntgactgtggtagctgggagccccaggatacagacttttggttaaataacatctgctccactctgccttcccgtgtgggcctctctaaccctgggccaagcagttgagtctctcctcggggtgcctggagtgagggtggatacagcttgggtaattcagcatctgtacctaaaaacttactcaaagtaggcttcatgtaaagaagtcagtggttcttgggaacaggggtgagtgaatggaggcgaaaggtggggccctccacaggtcagtcaggccctcagggtgggacaagagctgtagggctcttggttataaacctgtgtggtggagaccagcaggtgagccaaactcttctttattatcagaacatttcactaataagggatctcaagggtcatctggcatcagcactttaaccaataaaaaaaaaaaaaaaaaaaaaaaaaaaagggcggcc

SEQ ID NO: 3955 - DNA, 545 bp, Homo sapiens
agccagggttctagtcatttaagatgyacctgaataaaacaaagagccttactctcctagaacttgtgtttctacctggggagactgtcagtaaaccatccacaaaataaatacagcagatgctgttagaagatgatggtgctatggtgtgctgtggaaaatagagaaagtagagggaagtgagagggattgcgtacactaggattgtgactttacacagaagggtcagtggtgccattttagcaaagatctgagagaggtaaaggaataagctttgcagaagtgtgggagacaaatgttccaggtacaggaaatgaccaacgccaagaccctagggtggcaatgtgtctgcttkgagttctagagaargggtatattatacatcgctttttgtgactcactttttggcaaacattatgctctaaaatgaacctgtattttggaatawatckgtggttcattaattctcatctttgtacagtattctattatataaatacaccatgatttatttagtcaattaaaaaaaaaaaaaaaaaactcga

SEQ ID NO: 3956 - DNA, 1009 bp, Homo sapiens
aggttgcagtgaagctggagatggcgctactgcagtccagcctgggcgacagggcaagactccacctcaaaaaaatatataaaataaagtgggattcatccaagagcttgggacatgattaactaktgtcaaggagatatgtymtgccattattatcctccttacttggtagggtacaacagaaacagaacaacaaggtgacagccttttgctcaagtcaaaaagaaaataagtccctcatcttagtttaaagttgttcattcagtagtacagacttgcatttgaagacttattcttgatcttctgtagctttgacagcaaggacatcactacaatgggtacagaaataacacattctgatccttgctgagatccttgtatgggcctatcttaaatctagcctattgtctgtcttaccctttgatttttataagtrgaaaacaggaaaaggctaaccaagcaagaggaaggcatagattcatcttcctttcaatcttgactatagtttaaagagaataccatgatctttctgttctattcttggcttacttgaatatttagccaggtctctgcatcttattcagtcagaaaacagacacagattcagataactcaaaggatgttacttgcttgagtaatccttgggcctcgctttaactttgtagatccaggaacagaattaagcagacagttcggtctacactgccaaatttcttagggaaaaagagggcaagtcagaaggaggaagttggcatttggctcaaatgaccaaattatttaaggtctctacacttcactttgcaccaagtagacccaagaatgattataattcagctacgtgtggtggtgcagatcagtagtcctagctattcaggaggctgaggcgggtggattggttgagcccgggagtttgaggctgcaatgggctatgatctcrgmctgcgctttagcctgggcaacagaacaagaccctgtctcaaattaaaaaaaaaaaaaaaaaaaaactcga

SEQ ID NO: 3957 - DNA, 1307 bp, Homo sapiens
  misc_feature (651)..(651): n equals a,t,g, or c
  misc_feature (1064)..(1064): n equals a,t,g, or c
ggcacgagagaaaagaggttgagaatgttttctagcaggcagaatgtgcatacatgttttcatgartgtcctttgggtgctgtttcttttaaatcctctgtgcacagggctctggcctttartaaactgtttttctgtcttacgtcatgctgactgggtgctaggggctgattacaaaggggaagagttgaacagacatcaggggccgatgaaaccaaaggactaggagtcaggagaacaagtcagggattaggagacagcggtttggtttattgttatccagctggaggactcctaggggcagcagcaggaggaataccagggccacggaggggcaggagtctcacagtggagggcagactctaacagatgccagctgaacgctcgctggccctggatgtcatacgagttggggaccagaaatctgggctcagagaacccgtccagggagatttgaagccatgggttatcttctagagttgatactgataatatattttaatttttattgatgtttaataccttctgaaacaggagggtaagatcagatgggaagcccytctgttgaaggatcttgggaaccttggtggttttttttttttggtttttttttttttgatcgagctgtggacatccttcttaattcgattntgaggatttgtttaactaaaaagttcccaaacacagaaagggcctccccacctgctttggggagctgtctgtsctgggagtgccaggcatccsatgggacccatcactgccagtgtctgtgcctcccagaggtcagccctgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttnggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaatwctaaaaaaaaaaaaaaaaactggagggggggcccggtacccaaatcgccggatagtgatcgtaaac

SEQ ID NO: 3958 - DNA, 2988 bp, Homo sapiens
gggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgcaaaaaaaaaaaaaaagggcggccgctctagaggatccaagc

SEQ ID NO: 3959 - DNA, 1830 bp, Homo sapiens; identical to SEQ ID NO: 3729
  misc_feature (67)..(67): n equals a,t,g, or c
  misc_feature (97)..(97): n equals a,t,g, or c
  misc_feature (211)..(211): n equals a,t,g, or c
  misc_feature (1813)..(1813): n equals a,t,g, or c
  misc_feature (1830)..(1830): n equals a,t,g, or c

SEQ ID NO: 3960 - DNA, 1576 bp, Homo sapiens
  misc_feature (252)..(252): n equals a,t,g, or c
  misc_feature (804)..(804): n equals a,t,g, or c
ctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggantgttcctctacctccccagcattgggtactgtgtgctgctgacttttggattcggagccctgagcaaacataccaagaaaaagaaactcattgccgctgtcgtgctgggaatcttattcatcaacacgctgagatgtgtgctgcgcacggcgagtggcggagtgaggaacagcttttcagaagtgctctgtctgtgtgtcccctcaatgytaaggttcactmcamcattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaaacggtttgaagcagcagagcaaaakttaccggacagcaattaaacacagaagggaaatacccmgactgttactacaacctcgggcgtctggtaancgcggggtgccctgtgcctgtggaaggaaagatgggttattttycttatttataataaaatgacatagtgacacccacctagcccatacattttataaagttcyttcacatgtttctayctcatttgaaggtagctatttgattyccttttgagtaattttttaaagctctcattagagagcagtacagtgtgaattagtcaagtttaagaggtcacccacgcaaaaggttaaacccaggaataaattaacatgttaaagtcccgtccgccctgtaaaacagcactccaatgggtaacttcctgataaacatcagtttctctgtttttaaaacaagaattgagtaagaacagagattaaagtaacaaatycgtagtatgatttctgagctcccttgttctccttcttcaagggagcagagctcttcatctgcagggagcatttcccccaaaaaaggcagctttggagggcacgggatttatttgaaagggctttgacattatttggtggaaatagaaaataacgtgttctgtagtagctttatatttttggttattgacaggatgtttacgaagatctgattgctcttgattttcttgacaaaaataaaatgagacacacacatagcaaaattctttaaacacgaatggttgtcttctccctataatcaatcatttaatttggtttcaagaaaacaaatacatatgttcctaatatatttagatgtattcaataaacattgttaattaaaaaaaaaaaaaaaaaaactcgag

SEQ ID NO: 3961 - DNA, 2642 bp, Homo sapiens
ggcacgaggcgcgtctcaaaaggatggtgcgcctggcggccgagctgctgctgctgctggggctgctgctgctcacgctgcacatcaccgtgctgcgcggctcgggagccgccgacgggcccgacgcggccgcgggcaacgccagccaagcccagctgcagaataacctcaacgtgggaagtgacaccacatcagaaaccagcttttctctctccaaagaagcaccaagggagcatctggaccaccaggctgcacaccaacccttccccagaccgcgattccgacaagagacggggcacccttcattgcaaagagatttccccagatcctttctccttgatctaccaaactttccagatctttccaaagctgatatcaatgggcagaatccaaatatccaggtcaccatagaggtggtcgacggtcctgactctgaagcagataaagatcagcatccggagaataagcccagctggtcagtcccatcccccgactggcgggcctggtggcagaggtccctgtccttggccagggcaaacagcggggaccaggactacaagtacgacagtacctcagacgacagcaacttcctcaacccccccagggggtgggaccatacagccccaggccaccggacttttgaaaccaaagatcagccagaatatgattccacagatggcgagggtgactggagtctctggtctgtctgcagcgtcacctgcgggaacggcaaccagaaacggacccggtcttgtggctacgcgtgcactgcaacagaatcgaggacctgtgaccgtccaaactgcccaggaattgaagacacttttaggacagctgccaccgaagtgagtctgcttgcgggaagcgaggagtttaatgccaccaaactgtttgaagttgacacagacagctgtgagcgctggatgagctgcaaaagcgagttcttaaagaagtacatgcacaaggtgatgaatgacctgcccagctgcccctgctcctaccccactgaggtggcctacagcacggccgacatcttcgaccgcatcaagcgcaaggacttccgctggaaggacgccagcgggcccaaggagaagctggagatctacaagcccactgcccggtactgcatccgctccatgctgtccctggagagcaccacgctggcggcacagcactgctgctacggcgacaacatgcagctcatcaccaggggcaagggggcgggcacgcccaacctcatcagcaccgagttctccgcggagctccactacaaggtggacgtcctgccctggattatctgcaagggtgactggagcaggtataacgaggcccggcctcccaacaacggacagaagtgcacagagagcccctcggacgaggactacatcaagcagttccaagaggccagggaatattaaagagactgggatgaggtggaggacgctgcctctggttctggagcacacacgtgctgcactgacgtgccgactggcgccgagaccttcatagctgcggtcgtgtatatttgtatataccacatgagtatttctcatacattacgctaggggcgtgtgccacgcccaggggactgccttgtgaagccgccctcgccatctgcagagctccttgaaagtgcccctggggagcgatgtgggcagaaggatggggacaacttggaagccagaagaagaacctggaagccacagtgggtgcgactcaattcacacccggatccagagtttcaaagagaggcaaagggggaaagagactgaggttgtaaacgttataagcagtttttatatataacttatttaatacaaatgtgacttaattaagcgtaaccttttctctggagttgtggtgaaactaatcacgtctgtgagagatcagaaagaaagagacttagggaagtggaagagaaagggaattttggaatttatttctttaaaaataatgcaatggaaatatatcaaaacatgtaaacgcccaccttaaaccaaatgttatttggtcatgaggcaccttgctggagtctcagattccaaaagtctcttcttcagactgggtagggaatatgatattttagggacaaagctgaggactggttttaaataggctttaaaataaaagatcaatattatcataatgctatcattctgctaaacggccccaaaacagtagaatttctgctcatgtcctagcaggttcagaagactgcagccaagttcagatgtaaaaacaagaagtagcacttttccaaaggaaaacaacaaaacaaatgggaaaaagataatggaccgcatttcacctattttaatactattttaacaattttttcatctaccaatatatccccaataaataaatataaaagggggggagggtcaatctggggaatcttagttttttatgttttaagaaaacaaaaaaaactgcattatttttgtaaagtatttattgagtcacggattattgtgcatcaagcaattgttaatatgacctggtcctatggggtagaacttaggaaaaataaagttggttcttattcaatattttactttgcaaaattctagtaaaagagagtatataataaaatcataataaaaggtgaaaaaaaaaaaaaaaaaaaaaaaaaaaaaaaa

SEQ ID NO: 3962 - DNA, 757 bp, Homo sapiens
  misc_feature (705)..(705): n equals a,t,g, or c
  misc_feature (715)..(716): n equals a,t,g, or c
  misc_feature (752)..(752): n equals a,t,g, or c
ggcgcgtctcaaaaggatggtgcgcctggcggccgagctgctgctgctgctggggctgctgctgctcacgctgcacatcaccgtgctgcgcggctcgggagccgccgacgggcccgacgcggccgcgggcaacgccagccaagcccagctgcagaataacctcaacgtgggaagtgacaccacatcagaaaccagcttttctctctccaaagaagcaccaagggagcatctggaccaccaggctgcacaccaacccttccccagaccgcgattccgacaagagacggggcacccttcattgcaaagagatttccccagatcctttctccttgatctaccaaactttccagatctttccaaagctgatatcaatgggcagaatccaaatatccaggtcaccatagaggtggtcgacggtcctgactctgaagcagataaagatcagcatccggagaataagcccagctggtcagtcccatcccccgactggcgggcctggtggcagaggtccctgtccttggccagggcaaacagcggggaccaggactaccagtacgacagtacctcagacgacagcaacttcctcaacccccccagggggtgggaccatacagscccaggccaccgggacttttgaaaccmaagatcaagccagaatatgattcacagatggcgagggtgactggagtctctggctgkctgcancggcacctgnngggaacgggaaccagaaacggacccgggcttggggntaccc

SEQ ID NO: 3963 - DNA, 807 bp, Homo sapiens
aaaggtgmctaattaascgtaaccttttctctggagttgtggtgaaactaatcacgtctgtgagagatcagaaagaaagagacttagggaagtggaagagaaagggaattttggaatttatttctttaaaaataatgcaatggaaatatatcaaaacatgtaaacgcccaccttaaaccaaatgttatttggtcatgaggcaccttgctggagtctcagattccaaaagtctcttcttcagactgggtagggaatatgatattttagggacaaagctgaggactggttttaaataggctttaaaataaaagatcaatattatcataatgctatcattctgctaaacggccccaaaacagtagaatttctgctcatgtcctagcaggttcagaagactgcagccaagttcagatgtaaaaacaagaagtagcacttttccaaaggaaaacaacaaaacaaatgggaaaaagataatggaccgcatttcacctattttaatactattttaacaattttttcatctaccaatatatccccaataaataaatataaaagggggggagggtcaatctggggaatcttarttttttatgttttaagaaaacaaaaaaaactgcattatttttgtaaagtatttattgagtcacggattattgtgcatcaagcaattgttaatatgacctggtcctatggggtagaacttaggaaaaataaagttggttcttattcaatattttactttgcaaaattctagtaaaagagagtatataataaaatcataataaaaggtgaaaaaaaaaaaaaaaa

SEQ ID NO: 3964 - DNA, 276 bp, Homo sapiens
  misc_feature (1)..(2): n equals a,t,g, or c
nnatagctcaaccatgttccaggagtgtattccaatcagcttgttttttcttaactggttaaaggaatgttgctcattcacctgccccaactcacatattaacaattgtttaactgggattagataaaaggaaagctgacttacagatgaaccaagagggagctatttatgccacagcccccagcccagtaactttatgtttctgatctcctgcaaaatttttttataaaaaaagcttagccaggaactagtagaaagaataaagtaaagatggtg

SEQ ID NO: 3965 - DNA, 320 bp, Homo sapiens
  misc_feature (267)..(267): n equals a,t,g, or c
  misc_feature (294)..(294): n equals a,t,g, or c
  misc_feature (303)..(303): n equals a,t,g, or c
caggcgcgggcggccggccatgatcgcgtcgtgcttgtgttacctgctgctgccggccacgcgcctmttccgcgccctctcaratgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagntaaaggactagcccagagcagcctggnacttctganggataatcctggagaag

SEQ ID NO: 3966 - DNA, 2433 bp, Homo sapiens
  misc_feature (2422)..(2422): n equals a,t,g, or c
cggcacgagctaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaaaaaaaaaaaaaaaaaattactcggncgcaagggaat

SEQ ID NO: 3967 - DNA, 1063 bp, Homo sapiens
ccacgcgtccgaggagaacaagtggactcgggtagcttctatgagtaccagaagactaggtgtggctgtggctgtgttaggagggttcttatatgctgtaggtggctctgacgggacatctcctctcaacacagtggaacgttacaatcctcaggaaaacagatggcacactatagcccctatggggacccggaggaaacacctaggctgtgcagtatatcaggacatgatctatgctgtaggaggtagagatgacactacagagctgagcagtgctgagagatacaaccccagaaccaaccagtggtctccagtggtggccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatcttaaaaaaaaaaaacaaaaaaaaaaaaaaa

SEQ ID NO: 3968 - DNA, 616 bp, Homo sapiens
  misc_feature (1)..(1): n equals a,t,g, or c
  misc_feature (39)..(39): n equals a,t,g, or c
  misc_feature (297)..(297): n equals a,t,g, or c
  misc_feature (601)..(601): n equals a,t,g, or c
nacctgaaggttggcagttcccctgggaaaaagcttccnccattctttctggcatttattccatttctagagccctgaaacagttgcttttaacaattttgtctggtattattgttgttttgtggggagagattttgacttcctcactgtaactactaaaggtctgattctgtcctcagctacttttaaatgccctctttcatcttcaaacgtatcacctcatcacatgacataaaagtgcactgtaagtcaaatgtgagatcatcaagaataatgaacaggcctggcgtgatggcnaacatctgtgatcccagcactttgggaggccaaggtggaaggattgcttgaagccaggagttcgagaccagcctgggcaacatagcaagactccatctctatgtaaaaaaaaaggcattatcctgtattttcttctaattaggtttatatgtgtctcaaatttacatctccagtttgattttttctctgatctctaaatttgtatactcactgtctacctgatagccccacctaaatatctaacagatatctcaaacttagcattgctaaaacttattttatcccttcctcattaaaaaaaaanaaaaagggcggccgc

SEQ ID NO: 3969 - DNA, 1377 bp, Homo sapiens
cctgcaggtaccggtccggaattcccgggtcgacccacgcgtccgcggacgcgtggggtgtgagacgtgcctttcaccttccagcatgattgtgaggcctccccagccacgtggaactacctgcgcagaatgacggctggcttcatgggcatggcggtggccatcatcctctttggctggatcatcggcgtgctgggctgctgctgggaccgaggccttatgcagtacgtggcagggctgctcttcctcatgggaggaaccttctgcatcatttcactgtgcacctgtgtggccgggatcaactttgagctgtcacgctacccacgctacctgtacggactccctgatgacatcagccatggctatggctggtccatgttctgtgcatgggggggcctgggcctcacactcatctcgggattcttctgtaccttagccccttctgttcaacctgtcccgaggaccaactaccctaaatccagacccgagaatgggacagtgtgctaaaaaacaaacccatacatacatatatatatataaatatatatatataatatacatatataaaacaaaacaaaactaaatcaagacgatgccagtgccaaggtagagttgagttggctcaggcacctgcatctcgccggactttgtgttgcctcatctctgagatggggaaagtttttccatcctgtggctcttccatcagttcttgacttttggcttcatggtctcttgaagacagagcaaacaccaccacttgcgaccgcgtcttgatccccacactggcgaggatggggtggtgaagggacagtggaaggggtctgaggcagcacagatgtagagaaggaagtgccacccactgggtcaacgggagaggacgccacccctaaccagtcatatcacagggtaacaaagccctcagttcctagaatgtaaccaaattattgwkkyyattttcagaatcacttcttctcctgctcttcctgttcggacttccttcccagcccaccagcaacacacaaggagtggaagagaaaacaaactgagaaggacgttttctctttgctgccaaacttttggaccatgtttcataggtgggaagggaagagaacatgctgagaggcaagatctgcatcaatgaaaggacgcttcggtggatgctcagacaacccagtcttaccttccagctgccttacacccagtgaaacaagaggccaccctgtccccagccgcacctgcactccctgggcagactggagccttggagtcatgctgtgatgtgtgtgtgtgggtgtgcgtgcatgtgtactttgggcggtttcctttttttcttttctaccttttaaatggaaatactgcattaaaaaaaaaaaaaaa

SEQ ID NO: 3970 - DNA, 700 bp, Homo sapiens
  misc_feature (577)..(577): n equals a,t,g, or c
  misc_feature (626)..(626): n equals a,t,g, or c
  misc_feature (634)..(634): n equals a,t,g, or c
  misc_feature (639)..(639): n equals a,t,g, or c
  misc_feature (659)..(659): n equals a,t,g, or c
  misc_feature (696)..(696): n equals a,t,g, or c
cctgcaggtaccggtccggaattcccgggtcgacccacgcgtccgcggacgcgtggggtgtgagacrtgcctttcaccttccagcatgattgtgaggcctccccagccacgtggaactacctgcgcagaatgacggctggcttcatgggcatggcggtggccatcatcctctttggctggatcatcggcgtgctgggctgctgctgggaccgaggccttatgcagtacgtggcagggctgctcttcctcatgggaggaaccttctgcatcatttcactgtgcacctgtgtggccgggatcaactttgagctgtcacgctacccacgctacctgtacggactccctgatgacatcagccatggctatggctggtccatgttctgtgcatgggggggcctgggcctcacactcatctcgggattcttctgtaccttagccccttctgttcaacctgtcccgaggaccaactaccctaaatccagacccgagaatgggacagtgtgctaaaaaacaaacccatacatacatatatatatataaatatatatatataatatacatatataaaacaaaacanaactaaatcaagacgatgccagtgccaaggtagagttgagttggctcangcacctgnatctngccggactttgtgttgcctnatctctgagatggggaaagttttttccatcctgtggntctt

SEQ ID NO: 3971 - DNA, 1468 bp, Homo sapiens
  misc_feature (901)..(901): n equals a,t,g, or c
atgaattaatgtttataaatgactgtactgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatcccctttaagtcagggatgctttattctattttaaagcacttatgagttacatgttgtaatcaagtttgcacaatatatttatctatatgaggaacccataaatgaatagctaatttttaaaatgccattaaaatgcatgaaatkcttattaaaaccttactatactatttcttcaaggcaagtaaattgaccatgrgraaagracacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattacagttccactaaattgttgaagataaattatttttaaaggttatgaaaactaagttatattaattcatatgtttgatttttaaatcccacctcctcaagctatccaatttnctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtcttttatgttccatcctctgttgttactagatttagtttaaaaattgtgtatgaccattaatgtatgtcataaacatgtaaataaaagatgttgaatcttgttgaaaagcawraaaaaaaaaaaaaaactcga

SEQ ID NO: 3972 - DNA, 2860 bp, Homo sapiens
ccacgcgtccggactctgggccccactcaatctgtttctctcacgcacactttgtctctggggcacccaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcaagctgcaagctgcccaaatcctctgccgggagctgggcttcacagagccacagctggacccacagtgccaaatatggccctggaacagccgcatctggctggacaacttgagctgcatgggaccgagcagatgtgactgaatgtgcctcccggggctgggggaacagtgactgtacgcacgatgaggatgctggggtcatctgcaaagaccagcgcctcctggttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaagcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagtcgctgctctggacaggagctctccctctggaagtgcccccacaagaacatcacagctgaggattgtcacatagccaggatgccggggtccggtgcaacctaccttacactggggcagagaccaggatccgactcagtgggggccgagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgaggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctattttttactataatatgttgctaggtataattttattttatataaaaagtgtttctgtgaaaaaaaaaaaaaaaaaaaaaaaaaaaaaaaaaaaaaaaaaaaaaaaaaaaaaaaa

SEQ ID NO: 3973 - DNA, 436 bp, Homo sapiens
gttctcaccctccgccccctcattcacacttgtgattgattattattattaccatcctaatgcatgtgaagtggyatctcattatgttcttgatttgcatctctctagagagtaatgtcaatggctaccttttcatgtgtttgttgtttggatatcttctttggagaaatgtctatccaaatcttttgcccattttaaattttaattcttgccttttagatcttgagttgcaagaatyctttgtatattctaaataccagacctttaacaaatacatgatttgcaaatgctttttttcccatgctgtatgttatagttttactttcttgatagtattttttgaagcacaaacattttaaattttgatacagtttaatagatctattttttctttggttacttatgcttttgtgtcatatttaaaaaactattattg

SEQ ID NO: 3974 - DNA, 1092 bp, Homo sapiens
gaaactatccataatatgatgttttgttttgttttgtttttgagatggagtctcgctctgttgccaggctggcttgcagtggcgagatctcggctcactgcaatctcctgcttcctgggtttaagcgattcccctgccttggcttcccgagtagctgggactacaggcgcccaccaccacgcccggctagttttttgtattttagtagagacggtttcaccatgttggccaggatggtctcgatctcctgactttgtgatctgcctgcctcagactccctaagtgctgggattacaggcatgagccaccccacccggtccatatagtacaatcttaacccaaaaagtgtgtgtgtttgtgtgtgtgtgtgtgtgtgtgttttgtttttgacagagacatgtaggagacaggtggaaaatttgaggctgatgaaccaaagagaatttcgagtttttagtactatatgtggttgatacttgaagccatgggaaattgccaaatttatcaaagaaaagggattgtgtggccaacaggaatgttagagaaatttcaagagttgagggcaaagagaaaaatctagagaagaaattacctgtaatgtagaagaaaaagtacagttcactgaagccatgtttcatgcaggatgaagtctaatcctatgcagggatcactgaaaggtgactattgagaaaaagttattattggctgtgaggaagtttcaatagcatagtggaatagtaaagcaggtcacagggaacgaggagagaatctcctctgaggaagtgaagatgagcrgtagctggataggataccctggttgaggttgttttttaagttayagacaactgagtagttttgtagaggaggcatcctgtgaaagagaacagagttgaaggtgaaaaaacccaggaggaaggaggaggagattgaaatgagaacatgagtaaaatgggaactagagaaaaaggaatagttaatgagtgargatagatggagagatgttgagggaattcactttgacttgtgagtaaatcatattagaggggaaaaaggttcagatccaaactgggaacgacaggaaagtaaaaaaaa

SEQ ID NO: 3975 - DNA, 240 bp, Homo sapiens
gaatctatatatgcatctcccaacctctgtccttttgaacagacacaagtaacagaatttaccaaaagtattaaaaacacgaccttggaagcatcmtatcaaagccacaacttccttttctttttatgaactactaccatgcaaaattgcatggctacagctgggacatcaaatcatgctttaaaaaattagtattggggctaggcgtggtgcttacgcctataatccctgtactttggc

SEQ ID NO: 3976 - DNA, 630 bp, Homo sapiens
gaaaaaatatttggttagtttggattagaaatgatttatgttagccatgtgtttgaagatgaaattggcatcagtgtagacggtgctgattgggaaaagttcatgattaggaaattcatgtaagcctttttaagagtattttttaggttttcactcaatctttcctgtcacagtaacgtgaaaactgattattctttactccaagagaatgttttaacccaagcaagtatctaatactagagcattggttctgacattcattgtaaatcagtgaactgtaagatactgtctaaaaaatgtacatttgtaattagtgcctttattcatattttgaaataagttcttagttttatattatacctgttctttagaagtcatgttagcagctaattatttcagtgatgaaataatttgtgttttatatcccccttcacctccatgtattggttagcccagtttatagtaagtgaaaagcaagggacccacctacattmccttcaggagactgttctaccttttaatttgaaaacaaggaaattaaattttaacagaaatcttttaagtatgttataaccaaagtgttcaattatccttgcaagttcaaatacagcatttttcttaaaaaaaaaa

SEQ ID NO: 3977 - DNA, 1053 bp, Homo sapiens
cttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgagkcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggccggtgagggcccaggctggtcagcgtcccgtcttgcacacccaggggcctccctttctgctggagtcccctgtgtcctccaccaccccccgccgcccagcatcctacctggactgcggtgctacgagggcctgcgggcctttgctgtgtgccaccctccctgtaagtctatttaaaaacatcgacgatacattgaaaaaaaaaaaaaaaaaaagggcggccac

SEQ ID NO: 3978 - DNA, 770 bp, Homo sapiens
  misc_feature (579)..(579): n equals a,t,g, or c
  misc_feature (604)..(604): n equals a,t,g, or c
  misc_feature (639)..(639): n equals a,t,g, or c
  misc_feature (660)..(660): n equals a,t,g, or c
  misc_feature (723)..(723): n equals a,t,g, or c
  misc_feature (726)..(726): n equals a,t,g, or c
  misc_feature (737)..(737): n equals a,t,g, or c
  misc_feature (765)..(765): n equals a,t,g, or c
ggtacgcctgcaggtaccggtccggaattcccgggtcgacccacgcgtccggagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgnggtttactaataacttggatgtggnttcatcatatgtgcaagaccagagcgaaagactgnctatatttaaatatatatgtnccgactgaggatgatattcgggacagtgggggtcccaaaccaagtgatggtgtatatccatgntgnctcatattatnggaaggtacctggaaaatttatatgaanggaag

SEQ ID NO: 3979 - DNA, 2454 bp, Homo sapiens
  misc_feature (2317)..(2317): n equals a,t,g, or c
ggtcgacccacgcgtccgcttccatgtcaaatgtatgactgttatttcttcttctggaagagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaaaaaaaaaaaaaaaagggcggccgctctagaggatccaagcttacgtacgcgtgcatgcgacgtcatagctcttctatagtgtcacctaaattcaattcactggccgtcgttttacaacgtcgtgactgggaaaaccctggcgttacccaacttaatcgccttgcagcacatccccctttcgccagctggcgtaatagcgaagaggcccgnaccgatcgsccttcccaacagttgcgcagcctgaatggcraatgggacgcgccctgtagcggcgcattaagcgcggcggktgtggtggttacccgcagcgtgaccgttacacttgccagtggccctagcggcccgct

SEQ ID NO: 3980 - DNA, 1775 bp, Homo sapiens; identical to SEQ ID NO: 3792
  misc_feature (820)..(820): n equals a,t,g, or c

SEQ ID NO: 3981 - DNA, 1379 bp, Homo sapiens
gcggcgcgggtgggggttgtgcgttttacgcaggctgtggcagcgacgcggtccccagcctgggtaaagatggccccatggcccccgaaggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccaggtgcattccccatcttaactgatttaacccctgaaacaacccgacgctggaagttgggttctcatccccactctacatatgtaaaaatgaagatgcagagagatgaagctactttcccagggctatatggcaagcaagtcgcaaagctgggatcccaatccagacagtctgaccgtggaacgagactcatacacgtaataaatgctctgcccccaacttgtccaccacaaaaaaaaaaaaaaaaaaaaaaaaagggcggccgc

SEQ ID NO: 3982 - DNA, 421 bp, Homo sapiens
gcggaacgtctgccggtgtccccgcgctgctggtcccggggtccctgaaccgcgggcggccccgctccctctgctggccatggcccccccgcccgcgtgccggtccccgatgtcaccgccgccgccgctgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggcaaaaaaaaaaaaaaaaa

SEQ ID NO: 3983 - DNA, 614 bp, Homo sapiens
  misc_feature (591)..(591): n equals a,t,g, or c
gaaagaactgttggggcagatctgtttgttcatgtatttgaaagcatataaatgtgggcagcaagaaggtgtgagttgcaatagacagtaattgaaatatctattattggcacctgctatttgccaatggtacactattcatggtgtgcattattttgtcactttgctcagggaacttgtctacaaaattcattccaaagtgggctggttaaaggttgccaagggtcaacaggagggaaccagggttctttccaggcagctaaaatgagcccagtctgctactctggccacaccggctggctgtcacggccctgggcaaaaagcatctctcaaagtgcagatgacagaagtcctcctagcaggaggacttagccaaggtcaccaagtatttaggatggaatgaggattaaatccaagttggctgactcttccttcaatgctttctgctgtgccatgactccctcctgctttacaaaatgaataaggaggccaggcaccgtggctcacggctgtaatctgcatacactgggaggctgagatgascagatctcatctcaacttgaggkcaggagtttgagaccagcctgggcnacatggagcaaccccatctctac

SEQ ID NO: 3984 - DNA, 2264 bp, Homo sapiens
  misc_feature (299)..(299): n equals a,t,g, or c
  misc_feature (2257)..(2257): n equals a,t,g, or c
  misc_feature (2264)..(2264): n equals a,t,g, or c
aaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagscctccctgttccgccatgattctktggactctggwgtctctaagggagcatatgctggaatcacagggaacccatctggttggcatagctcttcccgaggtcatgatggcatgagccaacgtakgnaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcayacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttggataaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggnccccccn

SEQ ID NO: 3985 - DNA, 1015 bp, Homo sapiens
  misc_feature (1014)..(1014): n equals a,t,g, or c
ggcacgagcggcacgagcggcacgaggtgacttcaagtgtcggatcttttcagcctacatcaaggaggtggaggaacggccggcacccaccccgtgggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaaaaaaaaaaaaaaaaaaaaaaaaaaaaaaaaaaaaaaaaaaaaaaaaaaaaaaaaaaaaaacnc

SEQ ID NO: 3986 - DNA, 1098 bp, Homo sapiens
gaattcggcacgagctgaaatcttggagggaagaaaacacatcccaccctgcctccgggaaggggcctctcctggacatgtctcctgcagctgctgctgagccagatggggaccagcaggacagacacgtcagcaaactcatcttctgcttctttgtcttcggcgccgtcttgttgtgtgtgggagtcctgctctccatctttgggttccaggcatgccaatataagcccctcccagactgccccatggtgctcaagtggcggggctgcatgtgccgtggttgggcttgggggctgtgatcctggcccgctcccgggcgcaacttcagctccgtgcaaggctgcagagaggtcagcagatggaccccgaccgagccttcatctgtggagagagccgccagtttgcccagtgccttatctttgggtttctgttcttgacaagcggcatgctcatcagcgtcctgggcatttgggtccctggatgtggctccaactgggcgcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagarggacagatccagattatggagcctgtccaggtcactgtagcttctgcggtcgctgagagtcctggaactaacagtctgcttccgaatgaaaaccccccttcatattacagtattttcaactatgggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagcaaaaaaaaaaaaaaaaaatgaccctcgaa

SEQ ID NO: 3987 - DNA, 1017 bp, Homo sapiens
  misc_feature (822)..(822): n equals a,t,g, or c
  misc_feature (994)..(994): n equals a,t,g, or c
gaacaaagttcagtgactgagagggctgagcggaggctgctgaaggggagaaaggagtgaggagctgctgggcagagagggactgtccggctcccagatgctgggcctcctggggagcacagccctcgtgggatggatcacaggtgctgctgtggcggtcctgctgctgctgctgctgctggccacctgccttttccacggacggcaggactgtgacgtggagaggaaccgtacagctgcagggggaaaccgagtccgccgggcccagccttggcccttccggcggcggggccacctgggaatctttcaccatcaccgtcatcctggccacgtatctcatgtgccgaatgtgggcctccaccaccaccaccacccccgccacamccctcaccaccwccaccaccaccaccacccccaccgccaccatccccgccacgctcgctgargctgctgtcgccggtgcctgtggacagcagctgcccctgccctcccatctgttcccaggacaagtggaccccatgtttccatgtggaaggatgcatctctggggtgaacgargggaacaatagactggggcttgctccagctgcatttgcatggcatgccccagtgtactatggcagcagagaatggaggaacactgggtctgcagtgctgaagggtttggggagtggagagcaagggtgctctttcggggctggacagcccgtcttgtgacagtgactcccagtgagccccagaaatgacaagcgtgtcttggcagagccagcacacaagtggatgtgaagtgcccgtcttgacctcctcatcaggctgctgcangcctctggcgggcagggcactgggagaggccctgagaatgtccttttggtttggagaaggcagtgtgaggctgcacagtcaattcatcggtgccttagtccaagaaaataaaaaccactaagaaaaaaaaaaaaaaaaaatgaccctcgagggggggcccggtacccaattngccctatgaagaggcgaacagga

SEQ ID NO: 3988 - DNA, 2778 bp, Homo sapiens
ccacgcgtccgcacaagagagcagaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggagctggggaccctgaaccagacctgtggatcatccagccccaggaattggtgttggggaccactggagacactgtctttctgaactgcacagtgcttggagacggtccccctggacccatcaggtggttccagggagctggtctgagccgggagccatttacaactttggaggcatctcccaccccaaggcgacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagcaaaatctacctcttccaaagaggcagaattcaccagtgaacctgcaactgagatgtctccaacaggcctcctggttgtgttcgcacctgtggtcctggggctgaaggcaattaccttggctgcactcctactggccctggctacctctcggaggagccctgggcaagaagatgtcaagaccacaggcccagcaggagccatgaacaccttagcatggagcaagggtcaagagtgaggggtcagccccagagtgaggaccctctgagttggagaggagccagggctcctcaaccatttccctacctccagtcccagcctctaggtgcccccaggcctcatgacaaactcctagatccctacatctggttttggtccacctagtgaaattcccttctttgcaccgggcttccctctaaaatgtctccctttctctttttggcctgttcaagacctccttgcttttcagtccctggctcagtctctcctcaacacccttgcccctgctgcagccctttctggtgcgccctgcccctttccccacctcgctacatccttcttggcctccaacatccaactcagagtcttcttcccaggagatgtctgtaagaatctctgaactcaaccagccagaccatctgtgcccctccatctacacctttctccccactccttcctgccttccttccatccccctcatggctggcttgggcaggtataatattagaatgcaggttcagcaactataacaaagctcttaaataacagtggcttaaaccagtggaaatcaaccagaaagttgaccatcagcaggccaagcaatacagagactccctggtattgagacccaggattcactgatctcattgctaccaggtccaccttctaggcagccagactggaaaagagggcaggaaaggggagcaggaccctcccctttaagtgcacagtcaggaacttggccacctcacttatctctacttggctggaatgtggtcacatggtcacacctagctgcaagaaacactgggagatgtagtctttatttctggcagcaatgcgcccagctgcaagttttcactagagaaaccagatggcagatatcaggggataaccagttatctccaccacagcagcatacagacagcctctcacctgccctgtgggacacctgagttcaatgcccagctagctagccagcacttcttcccactatcacctcccctggggcagcatgatgtggggcagtagttcccaagatgagtgattttgcccccactggacttttggcaatgtctagagatgtttttggttggcacaacctgggggggtgctaccaccatctagtggactgagaagccctgacatggggaagagtgtgcatgcccaggagtcagacacacctgcctttaaccctgaggcctctgcctcctccctgtgcaccctcagtgactaatcagagtcccttcccatcacggaacatccaggatactaatgtggacttctctgcattgtgtaagaaccaattcaagaccaggcacggtggcttatgcatgtaatcccagcactttgggaggccgaggtgggtggatcacctgagttcaggagtttgagaccagcctggctaacatggtgaaacctcgtctctactaaaaatacaaaaaattagccaggcgtggtggtgtgcacctgtaatcccagctacttgggaggatggggcaggagaaccgcttgaactgggaggcagaggctgcagtgagctgagatcgcgccattgcactccagcctgggcaacaagagcaaaactccgtctcaaaaaaaaaaaaaaaaaacaattcaattctgcatttactgagggcctactatgtgctgtgtgcactgcgtgcactcgatacatgtaaattccctgttctctttccaggcaaacatttattagcactcactatagcggcgagtagatgagtctagatgtttttcattaccacaaacagaaaaacagcttgaactaagccagcgacaacagtaatttagtctgagaatggaataaattattgaattaccagacattagagagggtagggaaggtaggctgaatactaacccccaccccaaagatatccatgtcctaatctctggaacctttgactgttaccttgtatggcaaaagtaaaaataaaaagaaaaaagaaaacaagaaaaaaaaaaaaaaaaaaaaaaaaaaaa

SEQ ID NO: 3989 - DNA, 1840 bp, Homo sapiens
  misc_feature (1738)..(1738): n equals a,t,g, or c
ggcacgaggcaaaatctacctcttccaaagaggcagaattcaccagtgaacctgcaactgagatgtctccaacaggcctcctggttgtgttcgcacctgtggtcctggggctgaaggcaattaccttggctgcactcctactggccctggctacctctcggaggagccctgggcaagaagatgtcaagaccacaggcccagcaggagccatgaacaccttagcatggagcaagggtcaagagtgaggggtcagccccagagtgaggaccctctgagttggagaggagccagggctcctcaaccatttccctacctccagtcccagcctctaggtgcccccaggcctcatgacaaactcctagatccctacatctggttttggtccacctagtgaaattcccttctttgcaccgggcttccctctaaaatgtctccctttctctttttggcctgttcaagacctccttgcttttcagtccctggctcagtctctcctcaacacccttgcccctgctgcagccctttctggtgcgccctgcccctttccccacctcgctacatccttcttggcctccaacatccaactcagagtcttcttcccaggagatgtctgtaagaatctctgaactcaaccagccagaccatctgtgcccctccatctacacctttctccccactccttcctgccttccttccatccccctcatggctggcttgggcaggtataatattagaatgcaggttcagcaactataacaaagctcttaaataacagtggcttaaaccagtggaaatcaaccagaaagttgaccatcagcaggccaagcaatacagagactccctggtattgagacccaggattcactgatctcattgctaccaggtccaccttctaggcagccagactggaaaagagggcaggaaaggggagcaggaccctcccctttaagtgcacagtcaggaacttggccacctcacttatctctacttggctggaatgtggtcacatggtcacacctagctgcaagaaacactgggagatgtagtctttatttctggcagcaatgcgcccagctgcaagttttcactagagaaaccagatggcagatatcaggggataaccagttatctccaccacagcagcatacagacagcctctcacctgccctgtgggacacctgagttcaatgcccagctagctagccagcacttcttcccactatcacctcccctggggcagcatgatgtggggcagtagttcccaagatgagtgattttgcccccactggacttttggcaatgtctagagatgtttttggttggcacaacctgggggggtgctaccaccatctagtggactgagaagccctgacatggggaagagtgtgcatgcccaggagtcagacacacctgcctttaaccctgaggcctctgcctcctccctgtgcaccctcagtgactaatcagagtcccttcccatcacggaacatccaggatactaatgtggacttctctgcattgtgtaagaaccaattcaagaccaggcacggtggcttatgcatgtaatcccagcactttgggaggcccgaggtgggtggatcacctgagttcaggagtttgagaccagcctggctaacatggtgaaacctcgtctctactaaaaatacaaaaaattagccaggcgtggtggtgtgcacctgtaatcccagctacttgggaggatggggcaggagaaccncttgaactgggaggcagaggctgcagtgagctgagatcgcgccattgcactccagcctgggcaacaagagcaaaactccgtctcaaaaaaaaaaaaaaaaaa

SEQ ID NO: 3990 - DNA, 4385 bp, Homo sapiens
  misc_feature (3476)..(3476): n equals a,t,g, or c
gacctcgataacagttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtcggtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcagnccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaacccaaaaaaaaaaaaaaaaaaaaatgaccctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccacgattaaagaatgttatcg

SEQ ID NO: 3991 - DNA, 4386 bp, Homo sapiens; identical to SEQ ID NO: 917
  misc_feature (3477)..(3477): n equals a,t,g, or c

SEQ ID NO: 3992 - DNA, 4385 bp, Homo sapiens; identical to SEQ ID NO: 3990
  misc_feature (3476)..(3476): n equals a,t,g, or c

SEQ ID NO: 3993 - DNA, 4386 bp, Homo sapiens; identical to SEQ ID NO: 917
  misc_feature (3477)..(3477): n equals a,t,g, or c

SEQ ID NO: 3994 - DNA, 2013 bp, Homo sapiens
  misc_feature (49)..(49): n equals a,t,g, or c
  misc_feature (54)..(54): n equals a,t,g, or c
  misc_feature (685)..(685): n equals a,t,g, or c
aaagccccagctccaccgcggtggcggccgctctagaactagtggatcncccgntttgcaggaattcggcacgagtcatgtctgtgaaagtgaaactgaagaggaagaagagacaaaaaaccccaaacagaaaattgcccagacaaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgntactcagtatacatgaaattttttgcaggaaaagaaaccagaaatacagaataattcatagaaatcatggrtctcaagtatttgttcaattagctttggggaagaaatgccaaatccactttgaggatgagtcttacgacacagatccacccacakgttgctcttatctggaatttgggacaaagcaatgcacaggccctcattcctgatgtggcgccctccagacatggctgcccaggaaggacggccactttagaagtgggacgtatcaccagtaagcttgaatgwttaggatcgcaggtggctactgcattctgccgttcgtgaccgtgttctagcctgtagaccacccagctaccttcattcaccagtttttatccttcaccttttccagtatcktgttarccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaaaaaaaaaaaaaaaaaaaaaaaaaaaaaaaaaaaaaaaaaaaaaaaaaaaaaaaaaaaaaaaaaatg

SEQ ID NO: 3995 - DNA, 3387 bp, Homo sapiens
gctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcagcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgaaaaaaaaaaaaaaaaaaaaagtcgcacc

SEQ ID NO: 3996 - DNA, 741 bp, Homo sapiens
  misc_feature (27)..(27): n equals a,t,g, or c
gggttctgcaggtacggcccggattcncgggtcgaccacgcgtccggaccctgaagagcctgatggaggagagctggtcctggggggctcggacccggcacactacatcccacccctcaccttcgtgccagtcacggtcccygcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccmctatttccattgagcaaaaaaaaaaaaaaaaaaaaaaa

SEQ ID NO: 3997 - DNA, 723 bp, Homo sapiens
  misc_feature (530)..(530): n equals a,t,g, or c
  misc_feature (536)..(536): n equals a,t,g, or c
  misc_feature (576)..(576): n equals a,t,g, or c
  misc_feature (587)..(587): n equals a,t,g, or c
  misc_feature (594)..(594): n equals a,t,g, or c
  misc_feature (617)..(617): n equals a,t,g, or c
  misc_feature (704)..(704): n equals a,t,g, or c
gcarcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttyttcagtgtgccctgctggttacaccaccgatttgatcccaaagcctctagctccttcaggccaatgggaccaagtttgccattcaatatggaactgggcgggtagatggaatcctgagcgaggacaaagctgactattggtggaatcaagggtgcatcagtgattttcggggaggctctctgggagcccancctggncttcgcttttggccattttgatgggatattgggcctcggntttccatctgnctgtggnaagagttcggccccgatggatgnctggtggaacaagggctattggataaacctggcttctccttttacttaacaagggaccctgaaaagcctgatggaggaaaacttggnccttggggggctttggaac

SEQ ID NO: 3998 - DNA, 777 bp, Homo sapiens
  misc_feature (766)..(766): n equals a,t,g, or c
ggcagagcgttaagtcctcattccctccttctcctcttcctttctctgcagtaggggaggcccactcccgksggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattygactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttatgtgtttttccagagctttctgggatgtgggaaaataaattacactgaagcagttgaaaggtgaaaaaaaaaaaaaaaaaaaaaaaanaaaaactcgag

SEQ ID NO: 3999 - DNA, 1230 bp, Homo sapiens
cacgagtgccgctaaccttcttcatcctttggtggcaaagtagaaagattccagaattaactcgacctttctaaagacctgggctcagaggcagctggcactgactgagcacccactatgtgccaggcactgtgctgaatgcattagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaaaaaaaaaaaaaaaaaaaaaaaaaaaaaaaaaaaaaaaaaaaaaaaaaggggaggggc

SEQ ID NO: 4000 - DNA, 2254 bp, Homo sapiens
cgtgagaccagcggctgctgccctgccgcaagtacgagcagatcgaagagggcactgtccggcgcctcatcatccacaggctgaaggagacgatgatggtatctacctgtgcgagatgcggggccgggtgcgcaccgtggccaacgtcacagtcaaagggcccatcctgaagcgctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactacccgcttccgcatctgcacagtcagcggacatgccgtagtccccacgtggtgttccacggttctgctcacctttgtgcccacagctcgcctggtggcaggtctggaggatgtgcaggtatacgacggggaagatgccgtcttctccctcgatctctccaccatcatccagggtacctggttcccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgcccccggcgtgcaggattcagctgccctcacaatccaagagaagcccggtgcacatcctgagcccccaggacaaggtgtcgttgaccttcacaacctcgagcgggtggtgctgacttgtgagctctcaagggtggacttcccggcaacctggtacaaggatgggcagaaggtggaggagagcgagttgctggtggtgaagatggatgggccgcaaacaccgtctggatcctgcctgaaggccaaagtccaggacagtggcgagtttgagtgcaggacaagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagaccccgcgctgctcctgcagaaggaagacactgtccgccgcctggtgctgcccgctgtccagctcgaggactccggcgagtacttgtgtgaaattgacgatgagtcggcctccttcactgtcaccctcacagagtcttaccaaagtcaggacagttcaaataacaatccggagttatgcgtcctcttgaaaaagccgaagacccggcggctctggtcccgcttccccccatggccacgaacagctggcactgagtagcagctgcccccatagtttggggcccacattcctctgtcccacctccctgccattgctttttgcctctccccagaccgcttcaccttccacccgggtgtggtaccaggtaagtgtacccgtttgcgacccctgtgttaaaccaataaacatgcaaataaatgtacaacgtcgtgactgggaaaaccctggcgttacccaactaatcgccttgcagcacatccccctttcgccagctggcgtaatagcgaagagcccgaccgatcgcctttccaacaagttgcgcagcctgaatggt

SEQ ID NO: 4001 - DNA, 381 bp, Homo sapiens
gattaaggtagaaaagtacagaaaacactaaattttcattgtgctgtttcaatgtggcagattctttaaaatacttcgacacgctacaataattaaaggttttaagaacattaagatacttaaaaaataaaagcccacaattgaataacaaaaatgaactttgttttattttttattggcattaatgtaggttgccgtggtgaaaatagtttgaaatacttcacagtaacagttttktgcagccctagagattaaaaacagcaaagtaaataagcaggactctcaacgactcatactcacagactgtttaatgtwatcctarcacttcsggargctgargcgggaggattacttgagcctaggatttgagaccagcctggg

SEQ ID NO: 4002 - DNA, 1740 bp, Homo sapiens
  misc_feature (422)..(422): n equals a,t,g, or c
  misc_feature (1503)..(1503): n equals a,t,g, or c
  misc_feature (1725)..(1725): n equals a,t,g, or c
accgggtcccggcctgagtcgcggccacccgcaggtctgagctgtgggctgaggcagcgcaccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttctygggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggnagscatcacggatcatgaatttataccagtttattcaactttataaagatatcacaatcaagcagcagagtattggcacagagstccacctctgaagaacctgatgaaaactcatcctctgtaacatcttgtcaggctagtcttggatgggaaggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaattgctactgttttagaccatattttcctattatttatctgttcaaatttgtwtattacaactaatagctcttgaattctttgctaaaggtaacagcaacacttccagaggcttctaaaacactactgttttgcagggcaggagtattctggaatccttttacttasatataaaataaacctcgaatattaaaaagttgtaccatctgagagaggaaagtttaagtgactgaaaatgtagaatacttcaacgtgcatgttactacttaaaactagtctttctgctggaatctaaggagtatatatatatatgcccccttgtggttaattattgctcctttaataattttwacttgaaatgatccacaattatttcataactttagcagtgtgttttggaactactgtacttaaaggtttgtttgtttgtttttgccatactgtataatttgggtgargtctacaaaattgggtgtgacttncctttgcaaatggatttctcctggggaatttycttggctgttctggaaatgctttcccacagctgggtaactgttctaaatggctttgrataatgctccacacatcytgggagtttcaraaggaaattattctgcatcacaaatactaaatttatatttctaaattactataggtcattaatattggtttatggtgctttattccctaactggaaaacagcntctgagatttcagag

SEQ ID NO: 4003 - DNA, 1557 bp, Homo sapiens
caagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaactactccctatggaggtttatgcaagcagagtaccaggggttccatcatatcaacctggcaatgcacttggtggttgtgtgaccttgagaaagtctcttactcttgtttatgtgttcttactttagaaactgagactttatttgtggttttcacactatttcagcagcaaaaactttttcaaggaaaatcttacagaacctttaaacacgtgtgcatacacacataccctataccccactatataaaagtcatattattataaatttccttattatataaactttatatactataaatgtgattaagtcaatgaataaaaacattaatgcattggtgatatccagcatgtttgaatttggtgagtaacacacatatagtgggagtcgttttttttaaaaaaattttttaattaaattcaagtcaaatttgcagaaccctgtatctcctccatagattcttagtattccatggaacatattttgaaaaccttgggatagatgatccactgaaatcttttccagctctaagattttaaattgtccttttagattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtgattttagctaaaaaaaaaaaaaaaaaaaaaaactcga

SEQ ID NO: 4004 - DNA, 409 bp, Homo sapiens
  misc_feature (5)..(5): n equals a,t,g, or c
  misc_feature (265)..(265): n equals a,t,g, or c
  misc_feature (403)..(403): n equals a,t,g, or c
tcgcntcataattataaaccgggcccgggccccaaattgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacncatcttggagtttcagaaggaaattattctgcatcacaaatactaaattttatatttctaaattaggcccgtcatttaawattggtttatggtgcttttatttccttaacttgaaaacatctttctgagatttcagantcccaa

SEQ ID NO: 4005 - DNA, 2650 bp, Homo sapiens
  misc_feature (2603)..(2603): n equals a,t,g, or c
  misc_feature (2608)..(2608): n equals a,t,g, or c
cggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggamctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccagtggggagcccgcagcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagttaaaaaaaaaaaaaaaaaaaaaagggcggccgctctagaggatccangcttnacgtacgcgtgcatgcgacgtgcatgactcttctgatatgtc

SEQ ID NO: 4006 - DNA, 3024 bp, Homo sapiens; identical to SEQ ID NO: 936

SEQ ID NO: 4007 - DNA, 1516 bp, Homo sapiens
  misc_feature (7)..(7): n equals a,t,g, or c
ttgggcnccaaaaatcaacgggacttttccaaaatgtcgtaccaactccgccccattgacgcaaatggccggtaggcgtgtacggtggaaggtctatataagcagagctcgtttagtgaaccgtcagatcgcctggagacgccatccacgctgttttgacctccatagaagacaccgggaccgatccagcctccggactctagcctaggccgcgggacggataacaatttcacacaggaaacagctatgaccactagscttttgcaaaaagctatttaggtgacactatagaaggtacgcctgcaggtaccggtccggaattcccgggtcgacccacgcgtccggagcgaggctgccctttcttcgcagcgtgatttattttcttctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggscacccccaactacacgcactgtggcctcttcggggacccacacctcaggactttcaccgaccgcttycagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttycaggccttccacaccaatgctgarggcaccggtgcccgcargctggcagccgscagcctggacccacagsccccgagamcttyccatacsagacaggccgtggccaagtgcaaggagaagctgccggtggaggacctgt

SEQ ID NO: 4008 - DNA, 803 bp, Homo sapiens
  misc_feature (462)..(462): n equals a,t,g, or c
  misc_feature (696)..(696): n equals a,t,g, or c
  misc_feature (746)..(746): n equals a,t,g, or c
  misc_feature (761)..(761): n equals a,t,g, or c
  misc_feature (770)..(770): n equals a,t,g, or c
  misc_feature (780)..(780): n equals a,t,g, or c
  misc_feature (788)..(788): n equals a,t,g, or c
gactaccttttgcawaagctatttaggtgacactatagaaggtacgcctgcaggtaccggtccggaattcccgggtcgacccacgcgtccggagcgaggctgccctttcttcgcagcgtgatttattttcttctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatanaggacctcatgagccagcacaactgctccaaggatggccccacctcgcagccacgcctgcgcacgctcccaccggcggagacagccaggagcgctcggacagccccgagatctgccattacgagaagagctttcacaagcactcggscacccccaactacacgcactgtggcctcttcggggacccacaccttcaggactttcaccgaccgctttcagacctgcaaggtgcaanggcgcctggccgctcatcgacaattaattacctgaacgtgcaggtcaccnacacgcctgtgcttnccggctcancggccactgncaaccaancaaggcttaccatca

SEQ ID NO: 4009 - DNA, 1553 bp, Homo sapiens
  misc_feature (1512)..(1513): n equals a,t,g, or c
  misc_feature (1531)..(1531): n equals a,t,g, or c
cccgcagaacgccagggaccgcctgctgccaagggctcaggcatggacccctccccttctagtgcacgtgacaaggttgtggtgactggtgccgtgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggcccsaggcagggcaaccccggggcgctgcttggcaccttagcagactgctggaaccttttggccagtaggtcgtgcccgcctggtgccttctggcctgtggctgccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctccctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctatgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttcttttaaaaaaaaaaaaaaaaagsgcgacnnctctagaggatccctcgnggggcccaagcttacgcgtgca

SEQ ID NO: 4010 - DNA, 917 bp, Homo sapiens
  misc_feature (23)..(23): n equals a,t,g, or c
  misc_feature (30)..(30): n equals a,t,g, or c
  misc_feature (36)..(36): n equals a,t,g, or c
ggggggaaagggggggactatgngaatacnctttgntcaktagyyctgcagacttaaaagtgtaaatttagaattagaagatgaagctatwgtwgtaagaatctcaagytgaagggctttggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgcaaaaaaaaaaaaaaaaaaaaaaaaaaa

SEQ ID NO: 4011 - DNA, 638 bp, Homo sapiens
  misc_feature (604)..(604): n equals a,t,g, or c
  misc_feature (613)..(613): n equals a,t,g, or c
gaattaacattaattacaattaacaataattttaggtatggaatgttatgattacctaaagagatgtctctacctaatgagctcaagtgaatcctcccacctcagcctaccaagtagccagggaccacagggcaagtgcaccaccatgactggctagttttgttttttggtttttggtttttggtttttggttttttttttttttggttggttggttgttttttacaggcggggtctcactatattgtccaggctaraaraattttctaatggtctattacacctcccgttttggcaagtaaattcagaataattttaggttcttttgttattcagtagttttgcagacttaaaagtgtaaatttagaattagaagatgaagctatagtagtaagaatctcaagctgaagggctttggggagccaaagcagcatattagagcataggcttgaacttaaatctcagctcagttcacctgcaggactttagggcaccagtgaattttcacccttctgaagcctgttttctttattccgtaaaaatggattattaataatttcttttcacagcgttgtggaggatttaagtggaaatgtggttaaanggccccacnaccagttaggtggctccagatattt

SEQ ID NO: 4012 - DNA, 1868 bp, Homo sapiens
  misc_feature (26)..(26): n equals a,t,g, or c
  misc_feature (29)..(29): n equals a,t,g, or c
  misc_feature (53)..(53): n equals a,t,g, or c
  misc_feature (106)..(106): n equals a,t,g, or c
  misc_feature (114)..(114): n equals a,t,g, or c
  misc_feature (126)..(126): n equals a,t,g, or c
  misc_feature (161)..(161): n equals a,t,g, or c
  misc_feature (1865)..(1865): n equals a,t,g, or c
ggggcgggaaaaacgggttttgaccncancggggatttcccaaggtctcccanccccaattgaggccaatgggagtttgttttggcaccaaaatcaacgggacgtngggggggntgtcgtaccaanttccgggccccattgacgcaaatgggcggtaggcngtgtacggtggaggggctgtataagcagagctcgtttagtgaaccgtcagatcgcctggagacgccatccacgctgttttgacctccatagaagacaccgggaccgatccagcctccggactctagcctaggccgcgggacggataacaatttcacacaggaaacagctatgaccactaggcttttgcaaaaagctatttaggtgacactatagaaggtmcgcctgcaggtaccggtccggaattcccgggtcgacccacgcgtccgatcgcagtggctgcgcccgggatagctggctgcgccgccgcgcacatgcctaggttcgacgccctcctccctttgcccaggagttccttctgtcccggctctgttccgtctcgccccgaggttcacgccatcctcggagccccagcctttcacccagcgcctccaagctttggaccttgacttctgcaaaactagatggtcacagccatgaatgtctcacatgaagtaaatcagctgttccagccctataacttcgagctgtccaaggacatgaggccctttttcgaggagtattgggcaacctcattccccatagccctgatctacctggttctcatcgctgtggggcagaactacatgaaggaacgcaagggcttcaacctgcaagggcctctcatcctctggtccttctgccttgcaatcttcagtatcctgggggcagtgaggatgtggggcattatggggactgtgctacttaccgggggcctaaagcaaaccgtgtgcttcatcaacttcatcgataattccacagtcaaattctggtcctgggtctttcttctcagcaaggtcatagaactcggagacacagccttcatcatcctgcgtaagcggscactcatctttattcactggtaccaccacagcacagtgctcgtgtacacaagctttggatacaagaacaaagtgcctgcaggaggctggttcgtcaccatgaactttggtgttcatgccatcatgtacacctactacactctgaaggctgccaacgtgaagccccccaagatgctgcccatgctcatcaccagcctgcagatcttgcagatgtttgtaggagccatcgtcagcatcctcacgtacatctggaggcaggatcagggatgccacaccacgatggaacacttattctggtccttcatcttgtatatgacctatttcatcctctttgcccacttcttctgccagacctacatcaggcccaaggtcaaagccaagaccaagagccagtgaaggtttggagagaacaatgaagctccaggctctctcttctccagggcaccaagaggctgggcttagttttgggagaatgattaggttgccttacctgcatggtttccccagaggatgtgtgccccaaggtggctggaatttttgacagacaagaasggtgaccttgggatgggggtgtggtctgttactttaatgtttctgtttttaatgtgaaggccaagcaggccctgggatgggagtggggcggaggagggtcctaagagctgattatttaatttctatccagaaatctttcttcttcttgctctgtttttttaaattaaagatttcaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggnccc

SEQ ID NO: 4013 - DNA, 490 bp, Homo sapiens
  misc_feature (476)..(476): n equals a,t,g, or c
ggtcgacccacgcgtccggactagttctagatcgcgagcggccgccctttttgaatgctttctaatggttttcctccttaagtgtcaagttaacaattttaaccctatccagcaatactcccttttccctctgaaatccagtggcacatgttctatttctctcttttgtatgcgtggtttatatttttgtcttggtgtggttatttgcacacatgccatacttctaaaacccagctgtttggtgcttttcttagagtccttctttttccctgtgctgatgtatgcaggattcgggaactcttcatgaatagcacacactttggtgagaaatttagacttacctgaagattctgtggaacaggtggagaggattttcttttctttttttcacttttaataactttcactttaggatgattttaaaagtgaaaaaaaaaaaaagggcggcgctctaaagatccctccgaagggcccancttaccgtgcatgc

SEQ ID NO: 4014 - DNA, 886 bp, Homo sapiens
ggcagagcggatgtgggtgagagccccggatgagggtcccggatgtgagtgagggccccggatgtgagtgacggccccggatgaggaactcggaggaggagctgggcccgcgcgtccatgattcgaaggctcgttttcgcagcttttccacgtctttttccggtccmactgccctccatgctaactcactgggcgtctctagccgttataccaacaatgactgcgaccagtgttgggaaagcgccccctgggcccctccctgacgccagcccatccttgagactccctgcaaggaggcggcccgacccagtgggtgcgtgtcgtggggtgagaggaatggccgacctaatggtcccgcttccgtgagtagcacaggggtgcctgctcagagtgtagtacaacgctgacaagtagaaggcgaggattgcggggcctgggtgagatgggacccactaagttgtgggatcgaaatctcagtaggtccttggggaaagcggggacgggaggggagatgagcagattggaatagaaccgagagagacggaggaaactgacagttgcgtccctggtgggaagactaaaatctatgcagaaacagggataggcaaaagcattgtgcacaagcgggacaggcagagcgccgggacagaaacccttaggacattctgacaccttgctgaacctggatccttacagaatatgtcttgtaggtgaagctagatctgcaaggcataggcaagcctcttagagaatcagaaaagtgatttggaaggaacttcagctgttactactttgtttaagcaaatcaaatgctgttctttaatgttactggacgtttcaaattaaacacaagaaaacctgaaaaaaaaaaaaaaaaaaaaaaaaa

SEQ ID NO: 4015 - DNA, 3076 bp, Homo sapiens
  misc_feature (3064)..(3064): n equals a,t,g, or c
tagaaggtacgcctgcaggtaccggtccggaattcccgggtcgacscacgcgwmcgcacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaaaaaaaaaaaaaaaaaaaaaaaaaaaaaaaaaaaaaaaaaaaaaaaaaaaaaaaaaaaancccggggggggg

SEQ ID NO: 4016 - DNA, 652 bp, Homo sapiens
  misc_feature (1)..(1): n equals a,t,g, or c
ncacctggtggagggccgtgtgggaactwgtggrtcccccggggtkgcmgggaaaagaaatttgtatatagcccaaacttaagactgtctcaccagagcttaaaggtgttagctctggccacagcagcggcctcagtcactcttcttacatggattttgatgcaaattctgctccttttctatttctcaagatttctagccccttcgagggscccaaccctcgaaggagtccagtaaatgtgtaactccactctgccttgcctgtgctgaaaacacatagaaagaggaacagaggaggcaggcacctggaggtcagaatggcagctggattgtgaagaaggtgtggtttgcatgcctggcagtgatgagcttcttaggcttcattcttaacctcggagcaagactcattgtccagccacaagcagcgttggcctccagaggcctccgtgggcagggcctgccctgtgaaactcaggtctkcaagagaaccttgagaccaggtgccgtgggytggctggttcacaaaggaagacgggctytatccatttccaggaagagcgcccttgtctccctgggagtaatgtatgtgggaccaggcaagaggccaggagtggtgaggaaacattcccttcttgtgaaaatgcaagcgagg

SEQ ID NO: 4017 - DNA, 1093 bp, Homo sapiens
ggcacgagcggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacagggccttcgagacccagatgacgcgcctggaggctgagttcgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggcagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaaaaaaaaaaaaaaaaaaaaaaaaaaaaaaaaaaaaaaaaaa

SEQ ID NO: 4018 - DNA, 601 bp, Homo sapiens
  misc_feature (561)..(561): n equals a,t,g, or c
  misc_feature (573)..(574): n equals a,t,g, or c
ctccagactccgtattactcccctttacaaatgagaaaaatgtggctcagacagcktatgawacttgccawgaaccacacaacttgtgactggtgcaaattggattcagacccaagcctgtctcagaccttgtactttactttgatgaaaattggaagtgagttataacgtttagactataaaattcccaatactttaccaccaacattgcacttatgttyttgtttaaaaaaaaaaaagtctatggctgcctgcacctgagtacagtgtgaaatcaagaaacggcacagtttttggaaacatctgcttactgattgagcttcattaactcctcatgtgagatcccagtcctgaaccacaggtgctgttgcttacagtgcgtaagaaaaataaatgagttcagcttccaggttagtgctgtgaggttacataaactaatcattaaacatgacagctaagatattttagctactgtttaactttaaaagatttgttaataaataatgctattgcacactgaaaaaaaaaaaaaaaaaaaaaaaaaaaaaaaaaaaaaaaaanaaaaaaaaaaannaaacaaaaaaataaaaaaaaaaaaaaa

SEQ ID NO: 4019 - DNA, 272 bp, Homo sapiens
  misc_feature (272)..(272): n equals a,t,g, or c
aattcggctttcgagcggccgcccgggcaggtacatgacaatttttactccatttcttgttctcttacttctagtcaattctcccagattttctacaataactcttatgaggtctggttttcacaacccatcagtctgcttatcttttactctaaaacctcaatgctaccttgttttgatgtatcagaagaacaggagacaagatgggtcaaaagtattttttaaaactgcaagactaaagttctatctcaatataacagcaaagtgacagn

SEQ ID NO: 4020 - DNA, 800 bp, Homo sapiens; identical to SEQ ID NO: 962

SEQ ID NO: 4021 - DNA, 801 bp, Homo sapiens
ggaaacttgaaatgtggcaaaaaccacatgggcaaaatttctgtctcttttcttatttttgcttttttgtttaaaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttcaaaaaaaaaaaaaaaaaaaaaaaaaaaaaaaaaaaaaaaaaaaaaa

SEQ ID NO: 4022 - DNA, 939 bp, Homo sapiens
  misc_feature (451)..(451): n equals a,t,g, or c
  misc_feature (459)..(459): n equals a,t,g, or c
gggacgaggggggtgcggagccagccaggccgccctcccgttctcacagcagccgagcagagcgcagagcgggctgccatggctctggccaggcctgggaccccggacccccaggccctggcctctgtcctgctactgctgctctgggcccctgccctttccctcctggctgggacggtgccttcagagccccccagtgcctgtgcctcagacccgtgcgctccagggaccgagtgccaggctaccgagagtggtggctatacctgtgggcccatggagccccggggctgtgccacccagmcatgccaccacggcgctctgtgtgtgccccagggtccagatcccaacggcttccgctgctactgcgtgccgggtttccagggcccacgctgcgagctggacatcgatgagtgtgcatcccggccgtgccaccatggggccaccttgccgnaacctggncgatcgctacgagtgccattgccccttggstatgcagccccacatctgaatcctctttcctatgtttggggaatcccccaccttatgaggcagcgcctacctccagatggtgattcaaaagcaaatgactcaaagaagctgggtcctcagaaaatctattctggcaagtgaaagcagcaagcacagcagcttcatccagtttccagagacagtaattctacctacagtgtctagcaccccctgatggtattggcgattcaacctcgtctgtgcctagaatcttgttcctggatgctaacttctcagcctatttctccagccctccaagagattytgtgagccacctaacaccctgttcataagttcctttcccagactcaatttctgttgctcacaactaaaagtcttgactattaccccatttgataaatgtgaaaaaaagctaataactttgaaaaaaaaaaaaaaaagggcggccgc

SEQ ID NO: 4023 - DNA, 1122 bp, Homo sapiens
  misc_feature (101)..(101): n equals a,t,g, or c
  misc_feature (1108)..(1108): n equals a,t,g, or c
  misc_feature (1115)..(1115): n equals a,t,g, or c
ggtctttatataatgaaagagaagaaagtcacacttccgtcgagcagccaatatatgcctcattctgcagcaggtaatctaagatagwtgtaacagagcanymttaagaattagcagatatgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaatgaagaatgacacagtctgggatctcaacatgtataaaagtgaatactttattaaacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatatctttcatcatcctctttatcttgtattttataggcatggccatagaaatatcatgktttactgtgcgagaaaacaaactgctgcttatgkttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatagacaccttgggaagasatggrkgttccmcgaaaggaatcccaggggaataaaaccctttgaaagancccggtnccaattg

SEQ ID NO: 4024 - DNA, 222 bp, Homo sapiens
  misc_feature (216)..(216): n equals a,t,g, or c
  misc_feature (220)..(220): n equals a,t,g, or c
ttttttttttgaagatttcagtgatctttaatgacacagttaaaaagacaatgcaagaatgcagtgcaatgaaacagatcttcaaggatttattcactggattcctttcgtggaacatccatctcttcccaaggtgtctatgtgactctgagatttwtccttaaaatcacagcacttcaattgctgcagtaccctcaaagaggcttgctttagaangctntt

SEQ ID NO: 4025 - DNA, 1180 bp, Homo sapiens
  misc_feature (6)..(6): n equals a,t,g, or c
  misc_feature (9)..(9): n equals a,t,g, or c
  misc_feature (14)..(14): n equals a,t,g, or c
tccccnggntgcangattcggcagaggttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctygcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtctttttttttttttttttttttggtatattgctgtatctactttaacttccagaaataaacgttatataggaaccgtcaaaaaaaaaaaaaaaaaaaaaaaaaaaaaaaaaaaaaaaaaaaaaaaaaaaaaaaaaaaaaaaaaaa

SEQ ID NO: 4026 - DNA, 1514 bp, Homo sapiens
  misc_feature (71)..(71): n equals a,t,g, or c
  misc_feature (73)..(73): n equals a,t,g, or c
  misc_feature (643)..(643): n equals a,t,g, or c
tgatccctggctcagacagttcagtgggagaatcccaaaggccttttccctccttcctgagcctccgggcnangagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcanccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaaaaaaaaaaaaaarggggggccgctctaaaaaatccaagttta

SEQ ID NO: 4027 - DNA, 2105 bp, Homo sapiens
ggtcggggtgccgctgagcaccgcaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctmaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccrtccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagatacccaaaaaaaaaaaaaaaaaaaaaaaaaaaaaaaaaaaaaaaaaaaactcga

SEQ ID NO: 4028 - DNA, 1174 bp, Homo sapiens
  misc_feature (2)..(2): n equals a,t,g, or c
  misc_feature (5)..(5): n equals a,t,g, or c
  misc_feature (175)..(175): n equals a,t,g, or c
anccncatgcacgccaggttccaacagccggtttctagtgttccagaatcagtatccagtggtgccaaggcgctgccgggggccgagagctcagtggcagtgctgagagcccggccacagccccatctgaccccactcctgagctggcgtcccggcggatgggaagggtggccgncaagggctctggctggtggccaccgtcggcagccgggcctcgacggccacgtgatctagccctgggccagctctcacttagggcctcggccatacgtacatggcttagccccaagtggcccctgaatcggatctcccttcgctcctcacccccagggctgtctccgccgagcacataaaccctggccgagcggctgmgcacaggtgccagcgcctagccgattcctgtcactgcaragatgtccccgccccctcctgggatggctggracgcggtggaccggttgatggtgtragggctgctgtgggaccacgggggacaccgcgtggcactccagccgctcccgtcaccaaggcctcactggctacagccccggccacacgggtgccgtccccacgaccagggtggctctgcttgttctcccgctgcgccagaggcagctccacggtggcatccagaccccagtgagcagcgggtccagaccttccagcctttggctctccagccagaaccccagagacaccagacgaagggtcattcatgttggcccaggtgacagagaggctccattctccgtcaggcagccagtcagccgcggcgcccaggtcctgctaggggtccgagcctttgtgtagctgaggtgccctggcattcggcccctctggcttggtgggggggtgccaggcccaggctgtggggcgactggaggaggccccacggctgagggtctgcacctgagccttctccaggccctcgctgcacccctccttgctgtccccacagcagcccccacgctgggaggagccttccgcccagcccaggcccaccaagccctgcagccggccttgctggggagcagctcctcatggttcagccactgtgggccttgacagctcccctcggctscccttggaccccaaggcctccgagtccccgtgctccctgcccccgtggcttcctcctttctaggacattccccacatcaagggctgtgtcggcc

SEQ ID NO: 4029 - DNA, 849 bp, Homo sapiens
  misc_feature (14)..(14): n equals a,t,g, or c
  misc_feature (17)..(17): n equals a,t,g, or c
  misc_feature (84)..(84): n equals a,t,g, or c
gctaatttcggaangcntggaagttccctacacgatcaaccggtccaccgcgtcccagccatcccaggagggggtggggacatntctgcagtgacaggaatcggctaggcgctggcacctgtgmgcagccgctcggccagggtttatgtgctcgrcggagacagccctgggggtgaggagcgaagggagatccgattcaggggccacttggggctaagccatgtacgtatggccgaggccctaagtgagagctggcccagggctagatcacgtggccgtcgaggcccggcctgccgcacggtgccaccagccagagcccttgccgcccacccttcccatccgccgggacgccagcctcaggagtggggtcagatggggcctgtggccgggctcctcagccactgcccactgagctctcggccccccggccagcgccttggccaccactggtatagctggattcctgggaacacctagaaaccgggctgcttggaaacactgtggcgttgccatgtggggctcttcctccgcccgccagggaggctgtccccggtgcccggtgctgtggcccacacccgccaggttgcagaacgtgtgtccccctggcgaggccccccagaaccgtgtttttttttttctaaaggagctgactcggggccaagcacattcctcccggcccccgaggcttgctcttgtccagccctgggaacgcacaggcggccgagcccgtggcctggccgaggaggccgccgctctgcgaggggagcgctgttttccaggccggcgtctggaatgttgctctgccttgcggtgtgagccgactcctgcccccatttcagctgcggccgc

SEQ ID NO: 4030 - DNA, 753 bp, Homo sapiens
  misc_feature (745)..(745): n equals a,t,g, or c
  misc_feature (752)..(752): n equals a,t,g, or c
gaattcggcacgagcggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaatataaaaaaaaaaaaaaagggnggccgcnc

SEQ ID NO: 4031 - DNA, 634 bp, Homo sapiens
ggcacgagtgaccacgcagttctctccagacaggaagtagctgtcaggctgcccagggttccagttctcatagagcagggggacgccatccgaccacaagaagtcgccttcgatggtcctgtcgttgagtccgatccactggtactcccggtaccggttgttgatgaagtcctgttcctcgggtgtgctgatgctggccagatgcgcgccgtacatccggcactgggtctctgcctcctcccagctccttcgtgtggaaaagtgcttgtagcaggcgccctggaaggcgtcccagccggggttgcagaagcggaggccaacatcgcacaggtcccccccatagccaggcagacataggcagcggaccccttcctcctcctccaagcatgtcccaccattgtggcaggggctggggacacagtcacctgatgcggggaccacggccactccacctcggctggcgctgtcagtgggcagcactggctgggcctgcactgaggtccctgctggggcagttcttccagaattatcttcagagggggcctccagctccctggtaccctcaggggcccgtgtggctggaagcagggaaggggcaccctcggagcttcctgtctcctcgctctctcctcga

SEQ ID NO: 4032 - DNA, 563 bp, Homo sapiens
atgaaggggagccgtgccctcctgctggtggccctcaccctgttctgcatctgccggatggccacgggggaggacaacgatgagtttttcatggacttcctgcaaacactactggtggggaccccagaggagctctatgaggggaccttgggcaagtacaatgtcaacgaagatgccaaggcagcaatgactgaactcaagtcctgcatagatggcctgcagccaatgcacaaggcggagctggtcaagctgctggtgcaagtgctgggcagtcaggacggtgccggtaccgattacaaggacgacgatgacaagtagtactgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggc

SEQ ID NO: 4033 - DNA, 2778 bp, Homo sapiens
ccacgcgtccggccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcaggtgagtgggtgggacccctctccaactaccttccctgaaggttcctgccaaggtcccatgagaactagctgcccttctccccacagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccgggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccacagatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagcctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 4034 - DNA, 3030 bp, Homo sapiens
  misc_feature (51)..(51): n equals a,t,g, or c
  misc_feature (3023)..(3023): n equals a,t,g, or c
  misc_feature (3026)..(3027): n equals a,t,g, or c
tgggaggtctatataagcagagctcgtttagtgaaccgtcagatcgcctgnagacgccatccacgctgttttgacctccatagaagcaccgggaccgatccagcctccggactytagcctaggccgcgggacggataacaatttcacacaggaaacagctatgaccactaggcttttgcaaaaagctatttaggtgacactatagaaggtacgcctgcaggtaccggtccggaattcccgggtcgacccacgcgtccggccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcaggtgagtgggtgggacccctctccaactaccttccctgaaggttcctgccaaggtcccatgagaactagctgcccttctccccacagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccgggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccacmgatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagcctamaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanggnngcc

SEQ ID NO: 4035 - DNA, 788 bp, Homo sapiens
ccccctgcaggttgagatgtgtataagagacacgcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctgggcaggcaccaagcctaggggaccgtacccgctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtytcctggatgcagatggacggttcaggaagcatgaggcgttcctgccttctccttaaggaagcgtgtctgccttggaaagggcctggcaaaagcggagctcttcctyttcttcaccaccatcctacaagccttctccytggagagcccgtgcccgccggacaccctgagcctyaagcccaccgtcagtggccttttcaacattcccccagccttcca

SEQ ID NO: 4036 - DNA, 964 bp, Homo sapiens
  misc_feature (933)..(933): n equals a,t,g, or c
tggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacactgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacmtcagccgccagtggcagccccgagggagctagaatgaccacagttcagaccatcacaggcagtgatcccaggaagccatctttgacaccctttgcaccgatgacagctctgaagaggcaaagacactcacaatggacatattgacattggctcacacctccacagaagctaagggcctgtcctcagagagcagygcctcttccgacggcccccatccagtcatcaccccgtcacgggcctcagagagcagcgcctcttccgacggccyccatccagtcatcaccccgtcacgggcctcagagagcagcgctcttccgacggcccccatccagtcatcaccccgtcacgggcctcaragagcagcgsctcttccgacggcyccatccagtcatcaccccctcatggtccccgggatctgacgtcactctactcgctgaagccctggtgactgtcacaaacatcgaggttattaattgcagcatcacagaaatagaaacaacgacttccagcatccctggggcctcagacacagatctcatccccatggaaggggtgaaggcctcgtccacctcgatccaccagctntgcctgactccactaacacaaaaccacacat

SEQ ID NO: 4037 - DNA, 1945 bp, Homo sapiens
gcccacgcgtccggccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctcygtggagacatcarccgccagtggcagccccgagggagctrgaatgaccacagttcagaccatcacaggcagtgatccsagggaagccatctttgacaccctttrcaccgatgacagctcttaaraggcaaagacactcacaatggacatattgacattggctcacacctscacagaagctaagggcctgtcctcagagagcagygcctcttccgacggcccccatccagtcatcaccccgtcacgggcctcagagagcagcgcctcttccgacggcccccatccagtcatcaccccstcatggtccccgggatctgaygtcactctcctcgctgaagccctggtgactgtcacaaacatcgaggttattaattgcagcatcacagaaatagaaacaacracttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcrccayagaaagagaagtgacagcacccrgggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctraccccagatgtggcaacaggaccctcgctcacatccaccggagtgtatgtrtggggaggggcttcacctgttcccagaggtgtccttggactcaccttggcacatgttctgtgtttcagtaaagagagacctgatcacccaaaaaaaaaaaaaaaaaaaaaaaaaaaaaaaaaaaaaaaaaaaaaaaaa

SEQ ID NO: 4038 - DNA, 823 bp, Homo sapiens
  misc_feature (639)..(639): n equals a,t,g, or c
  misc_feature (688)..(688): n equals a,t,g, or c
  misc_feature (706)..(706): n equals a,t,g, or c
attcccgggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagkgcccagggcccgcgcacctgcgccgcacaggtacgaggcggtggcgggctccgaggcgggcgcgcagctgcacccggtcatcaccacgcanagcgcgggcggcgtctacacccccgctggccccggcgcgcgaacttcgnttaccggcttctccttcntcgtgtgagcaaaagcgccgcgctccytcagggcggaacggaggcaactttccggagtctatttttgktaagacaattcaactccaataaactgrgctgaagtttttgtttaaaaag

SEQ ID NO: 4039 - DNA, 943 bp, Homo sapiens
cgggtcgacccacgcgtccggatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcaagtgtctagtcaaggagtcggctttcargttcctgacggccaggcagggatgctaargtgtggctcasccgtcactgtctgtgtcactgcartggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcrtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacaaaaaaaaaaaaaaaaaaaaaaaa

SEQ ID NO: 4040 - DNA, 1717 bp, Homo sapiens
  misc_feature (665)..(665): n equals a,t,g, or c
cctgcagctaccggtccggaattcccgggtcgacccacgcgtccggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcgganctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagtttttacttgaaaaaaaaaaaaaaaaaaaaaagggsggccgc

SEQ ID NO: 4041 - DNA, 769 bp, Homo sapiens
gcacgagaatttttgtactgctatactcagttgcctgtctgtagtacccctgtacgtatcttttcttacaactctgttcccagtacccctatgtttagtcccttgttctcatgttctcactaccccaatacttaaaacttgttctcagtatccttgttgttagtaccctgttctcactccccttttcttagtacccctgaggggggaaaaaaggtgataatggggtataagtccaaaaacttttggattgtttgatttgaactgagtcaaagtaaaccagtgttctggagttcgacttcgggtgcaaatccctgttgcatcatttactggccttgtggctgaataggttattaaactctgtaaaatgggcattaaaacgtgtgtcattcatagtgttgctgtgaatatgtgagccattccatattgagggttcacacagtgtccagcaactggctaaagtttgcaaaccttacccattattattgtcattgttagtggtatactttgaggctgtcacaaataagcagatatttcttcttgtgagagctatataatcccttagtgtagagaaaaatttaattttgttacaagtgatccaagccaggtatggtggcaagtgcctgtatacccagctgtacttgggagggtgaagtgggaagattgcttgagaccaggggttcgaggctgccgtgagccttgtttgcatcactgcattccagcctggatgacatagcaagaccctgtctccttaaaaaaaaaaaaaaaaaaa

SEQ ID NO: 4042 - DNA, 1503 bp, Homo sapiens
caggttcctctcagtamarcctcarsccgaggttcccttcctcttgcatccatgtgtgtgtttcaraggcggccatccttccctacttccagatccttgtagggcagttggtggagggtgggaggcaccccggtgttgcctccatgaagccctgtgccagtcactgggctgcaaggctgaggaaattgtgtccgtgtcagaaagctcctcagctcagaggtgctggtacctcctgcgtggtaggaaggcagggggaagaggccctgcttctcctgttctctttgcccttatgagacttgagagtctgtgtcatctgtgccttgcatgtctttttttcagactccctgcgacaaggactgtgtactgcatgaatgaggctgagatagttgatgttgctctgggaatcctgattgagagccgyaaacaggamaaggcctgcgagcagccggccctggcgggggctgataacccagagcactcccctccctgctccgtgtcgcctcacacaagttctgggagcagcagtgaggaagaggacagtgggaaacaggcactgrctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatga

SEQ ID NO: 4043 - DNA, 1328 bp, Homo sapiens
cccacgcgtccgggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaawcwgactccctgcgacaaggactgtgtactgcatgaatgaggctgagatagttgatgttgctctgggaatcctgattgagagccgcaaacaggaaaaggcctgcgagcagccggccctggcgggggctgataacccagarcactcccctccctgctccgtgtcgcctcacacaagttctgggagcagcagtgaggaagaggacagtgggaaacaggcactgrctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatga

SEQ ID NO: 4044 - DNA, 750 bp, Homo sapiens
  misc_feature (432)..(432): n equals a,t,g, or c
  misc_feature (639)..(639): n equals a,t,g, or c
  misc_feature (713)..(713): n equals a,t,g, or c
  misc_feature (715)..(715): n equals a,t,g, or c
gcagcagtccacccacgttggcctcccaaagtgctgggattacaggtgggagccaccacacctggcccagtgcattctaagggatgttggccttggagccagggaggagggtcaggtgcagatgctgagatggcacctctggtcgtggttctgttggttctgcttgtcagaagctggggtccttctggatcttcccacctgaccgggcatgttctggcaccctgtgggcctttctctctgcacgctggtatctctttgggttttctccacattggctgttggctgcagcatgtttggctcagggaccctccggtgtcactgcacgatgccttctaggccttctcccaccgtggaatgctttcatccctcccggtggggagagagtgcatgctcagcgaggctctttgcagcaggtgttcaggaggcctcggngtggagggcatccagagaggagggcccccaccctgcactgcgcccaccaggccctgacctctgcagcagggtggtcaagtgctgcgtaccactgtgggctggctgtggagcaggcctgtgtgcaatggggcctaatgcaatgggggggtcatttaagctcaaaggcaacatgaaaacaagcccaagtctccctgggcaaaacccaangcagatcctgctttcccaatgcatgctttggggacaggttttggcttcaagaaccatgggtggttcaatacggnanacacccttaaaaagggggttttggcccctgggatg

SEQ ID NO: 4045 - DNA, 602 bp, Homo sapiens
  misc_feature (2)..(2): n equals a,t,g, or c
  misc_feature (25)..(25): n equals a,t,g, or c
  misc_feature (76)..(76): n equals a,t,g, or c
ancaatgagcaggcagcacagactnaatccacacggccccgacccggcggcgcctcatcgtgcctgtcgcctcttntccccccgccaggtcacttggctgactccagcagaggccctcccgctaaraccctgcccaagccagtgtggggctcactgcagacagcacgggcctgagcgggaaggcagtgcagasccagcagccctgctccgtccgggcctccctgtcttcggacatmwrctccggcttagccagtgatggaggcggagcgcgtggccaaggtgatttccagcttgcctgtctccgagcatgtgctagccacgtagggcctcagtggtgtccccaggagcacgcccgtgttgtgtagaggggttgcaagctgtggcaaaggctgttgagaggcttcttttaaaaaggataaaaaaaaaaaggtgtagtctttggatgaaaggaatggaattgtcccatccaccaccaagtcttgcttgtaagcagctcagggggaggattgcttgagcccgggaggcagaggttgcagtgaggcgagattgcaccactgcactccagcctgggtgacagagccagaccatctccaaaaaaaaaa

SEQ ID NO: 4046 - DNA, 563 bp, Homo sapiens
  misc_feature (505)..(505): n equals a,t,g, or c
  misc_feature (517)..(517): n equals a,t,g, or c
  misc_feature (526)..(526): n equals a,t,g, or c
  misc_feature (532)..(532): n equals a,t,g, or c
  misc_feature (548)..(548): n equals a,t,g, or c
gtgtgccctgagactgaccttgacaatgttcatccctcagctgcctgccttaggactgacttccttgatgatggccatttccttgaatgtgtctgtttctcagggtctgtcctctgcatgcatgcatttgcgcatgcaggcatgcaaacccacaagagtccaggctaaagttttgggggattgggtacaggaaaatcatgtcattgagaatggggcaaccctgaggccatggcaggatcccctgcatgacaaatatagaatgaagtaaaaataatcagaggaagccgggccattgatgatgctatcagtcttagtggggtgatacaccagacattctgtctcatttctcttcaaacgaccgcatgagtggtcatggaaactacaagtcacacctctccgtatttggaaaagcagatcgtttctctgacataggagtaataagctttcttgacattttgatagcagtgagggaagggaaaaaaggcagggaggaactggaggtggngtgaaggggtanaagcccgtnatgggncctaaaagctctctgnacccagcggttctgg

SEQ ID NO: 4047 - DNA, 660 bp, Homo sapiens
ctacactgaagggagaaaggctcttaaaagagaccattgtgtttaatctcactgggatggtcagttcctcttggccttcctgtttgctccgtagttgcgaacactagtttcaggggggtcaggctcccgatctgcgtcattatcctgtttaaatagggaggggcaggccctttcctgctgtctgtctcccatagtctctggctrtgaggcttgagtgacttggacatgacatttctctttctggttcattcattttccccacttccatctgaaaattctaaccaaatgtcttgctgaattctctaagtacaacaatttcaccctccctgcagacaatgaggraatcagagtccagaatccatttcaacttagcaaacatttactgagtctatattttgtttcggatactggggtaaagttctggaaatgcaaaaggaatttgcatctctgaacttaaggagttcacagtcttgaacagggcaatccaagttgtactgtaaagaaatagtatgatcgagaactgggaaaggaaacagcctttgaatagatacccattctggttaaatggaagatgggtttcgagggaggaaggaatttaatgcaggaaagccaattgggaagcaatttctgtgctacaaaaaaaaaaaaaaaaaaactcga

SEQ ID NO: 4048 - DNA, 743 bp, Homo sapiens
  misc_feature (664)..(664): n equals a,t,g, or c
  misc_feature (666)..(666): n equals a,t,g, or c
  misc_feature (680)..(680): n equals a,t,g, or c
gccggctctgctgccccctttctctccatggcagcggcccggaacctgcgcaccgcgctcatattcggaggcttcatctccatggtcggcgccgccttctatcccatctacttccggccccttatgcggctggaggaataccagaaggagcaggctgtaaatcgagctggtattgtccaggaagatgtgcaaccgccagggttgaaagtgtggtctgatccatttggcaggaaatgaggctgtcagcaagtctgatgaggaaagtggacgtctttatcctgtgcactccgcagtggggacaatagatgcctcactgtggcagcatggcatggagagggaactctcatgctgctagccagaccccttgtgatagaractgtgtgcaaagacagtgcttcccttaactccctggagaacctgaacagatgccaccattaggaagtgccttgcggctccattgactttgcaggagcagagccagcctgcaagtgtttgtggaagaactgctgctcctgcagtctttatcacttccaagctgtgatgtgaacacaagcaacctgtggggtcaagtccgtggctgctctgacaccttctgaataagcggtttcagtgcaaatggccttgccaagctgcctcgcaggctcttggaaggtgtttcagttgntnaaactgtttgaagncaggatcctttgcctgtttaaaaatttcactgctccagcttaaccatcctcattgaaagtccc

SEQ ID NO: 4049 - DNA, 797 bp, Homo sapiens
taccggtccggaattcccgggtcgacccacgcgtccgatatcactcagtgtttgtgttttcttctctttctagagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagttataataattacggatcagtacggaaatcagattcaagcattttcaccaagttctttatcttctttgtcaattgctggggttggacttgatagctcaaattttgaaaacaacctttcaggaaaacacacagaagtataagtgtaagaggcatcaaatttattccaggtcctcctggaaataaggatctttgrtttacttggcgtgagtttgtctgactttattcgagtgcactaattctggacctyctgctaaactt

SEQ ID NO: 4050 - DNA, 1514 bp, Homo sapiens
  misc_feature (1472)..(1472): n equals a,t,g, or c
gccgtaatgttgtytcrgtgcsataayccagcaccggtacaacatgttaaaataagtcttacaaaagctagcaatttawwggggagagcatactcttcaggttaaagccatctataacaaaagtatcatagaaggacctataattaagttaatgattcttccagacccagaaaaacccgttcgtctcaatgttaaatatgacaaagatgcrtccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagwggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttaccagaagactcttccagattggaaaagatctctacctcatttccgaaatggaaaattgnattttaaacccattggagatccagtctttgctcgagacttgt

SEQ ID NO: 4051 - DNA, 529 bp, Homo sapiens
  misc_feature (521)..(521): n equals a,t,g, or c
  misc_feature (524)..(524): n equals a,t,g, or c
  misc_feature (526)..(526): n equals a,t,g, or c
cagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgwgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagargctggagacaaaagaaangangngag

SEQ ID NO: 4052 - DNA, 960 bp, Homo sapiens
taatctcagaaactttaaattatttctccttttttggagcagttgaaataagttgctcactacttactattcacttatttacaataggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtraataaggatcttaacagtcaattagagtaccttcgcactccggatatgaggaagaaaaagcaagaacttgatgaacatgagaaaawtctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactaaaaaaaaaaaaaaaagggcggccgc

SEQ ID NO: 4053 - DNA, 638 bp, Homo sapiens
  misc_feature (590)..(590): n equals a,t,g, or c
  misc_feature (599)..(599): n equals a,t,g, or c
tgtggaaaacagtaggaaagcaatgaaagaagctggtaagggaggcgtcgctgattccagagagctaaagccgatggtaggtggagatgargargtggccgccctccaagaatttcactttcacttcctctctctctctgtcttcactgactgcacttcttcaggagaagcttttgttatctgtatcacgcagacatgctgctctttctgtttgtgtgcttacccatcacttggatggcagaattcttgtcacaactgagacacctyctataaaagtaagctgaaaggaacagcatcctcgtcagtgctcggcaggggcgggtaggggatgatggttttttccctaaggtaaaactgctgttgctcttgtttcctttttaactgtcagtgtttggctttcatcagactgaacattttggtgtacacttgaactgacggtttgatttttatcattttggaaggtgatcatagcaattcctttcaacttgctaaaattcatactcccccttttaaaagtatggttctgcttacattgctgtccttttcccttggctgactttttcttctgttgcctaggttgtacttttttnttttttttntttttcagtagcaaacaaggctgttttcatcaataccca

SEQ ID NO: 4054 - DNA, 1737 bp, Homo sapiens
  misc_feature (1674)..(1674): n equals a,t,g, or c
  misc_feature (1731)..(1731): n equals a,t,g, or c
gtcgacccacgcgtccgcccacgcgtccgcccacgcgtccggtttataaacagaagtttaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcatgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaacaaagaatgatatgtgagaagatggccaatccagtgcagcttggttctacatattttagggaggcatgaggcatcaatcaaatacattgaaggagtgtakggggtgggggttctaggctataggtaaatttaaatattttctggttgacaattagttgagtttgtctgaagacctgggattttatcatgcagatgaaacatccaggtagcaagcttcagagagaatagactgtgaatgttaatgccagagaggtataatgaagcatgtcccacctcccactttccatcatggcctgaaccctggaggaagaggaagtccattcagatagtgtggggggccttcgaattttcattttcatttacgttcttccccttctggccaagatttgccagaggcaacatcaaaaaccagcaaattttaattttgtcccacagcgttgctagggtggcatggctccccatctcgggtccatcctatacttccatgggactccctatggctgaaggccttatgagtcaaaggacttatagccaattgattgttctaggccaggtaagaatggatatggacatgcatttattacctcttaaaattattattttaagtaaaagccaataaacaaaaacgaaaaggcaagttacgagactgacttatttttaacttctgtgtgttgagctactgtaagcttggcttttgttaaagacatacagcaattagctatgcaaacataagcattgttctgaaaaaaaatntatagatagatatgtttatctcccataactcataactggggagtattataccccggnggcttt

SEQ ID NO: 4055 - DNA, 1742 bp, Homo sapiens
  misc_feature (35)..(35): n equals a,t,g, or c
  misc_feature (570)..(570): n equals a,t,g, or c
gtcctgcaggagctgcacgcggccgaggtgcgcangaacaaggagcagcgagaagagatgtcgggctaagggcccggsacgrgsggcgcccatcctgcgacggaacacgttcgggttttggttttgtttcgttcacctctgtctagatgcaacttttgttcctcctcccccaccccagcccccagcttcatgcttctcttccgcactcagccgccctgccctgtcctcgtggtgagtcgctgaccacggcttcccctgcaggagccgccgggcgtgragacgcggtccctcggtgcagacaccaggccgggcgcggctgggtcccccgggggccctgtgagagaggtggyggtgaccgtggtaaacccagggcggtggcgtgggatcrcgggtccttacgctgggctgtctggtcagcacgtgcaggtcagggcaggtcctctgagccggcgcccctggccagcaggcgaggctacagtacctgctgtctttccagggggaaggggctccccatgaggraggggcgacgggggaggggggtgatggtgcctgggaagcctgcktgtgcanccggtgcttgttgaactggcaggcgggtgggtgggggctgcagctttccttaatgtggttgcacaggggtcctctragaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccgtgggacagccccgccgcccctccccaccagggctttgcagatgtccttgaaagacccaccctagagccctttggagtgctggcccctcctgtgccctctgccctggtggaagcggcascacaagtcctcctcagggagccccaagggggattttktgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagccacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaagaaaaaaaaaaaaaaaaaactgcg

SEQ ID NO: 4056 - DNA, 1198 bp, Homo sapiens
  misc_feature (1178)..(1178): n equals a,t,g, or c
gccactgtggcctttaatcagtccttctattcacttccgcttctcccacctttactccattgtgcttgcaaatccagtgcccctctggggcccttctagttggtgagtcagctcccatacctgctgcagcactttggtgatactctaagtggtatcgtttgttttatgcaagttttctctgctctgctttattcgttaatgcatttttatttgccatcttttacactagaaatgtatttaaataccttgttgtctcatgaccttctttctttttttcattgctctggcttagtcttttttgtttattttaaatctgtaactggtcttttctctggggtctgaagagagatgagaactgagagcatatgtgcactctgctctctggaactaggagcccaggcctcacctgctgtgcttgagtctttcctcgttatttctgttgagtgtctttttctccttctatactcaatgtttcttcagatcttagggaataaactgaacactgtgatatatatgaatagagtagatatttactaaataattatgatgtccccaaatagatacaaaccaagtaaattaaacaccagacttatttatgttgkctgagaaagtcatatttgaaagaaaatttaccccaaactgttcgttggaccatcccttawtcttataaacaggkctttattcttataaactttattcttagaaaaacagtgtctgcttttctacccccacttttctatgtcacatttgatttggggaaaataaattatacaaaataccatattatcccatcctataaattactcccggaaaacaagtcatgtgtttagaagctgtgccattaagactgatttcttttgcatactttgtgttacaacacttgtcactattgcagttgttggtttacatgcctgacttcctcaaagaggtcctgagagtagagaatgtgtcttactcttgccttctcttagcctagtttggtatttgacaggaccagagaatagaagtgatagatacaatgataactactattgattgtgkttcttttgtttataggcactgtacatgccacttctacccacattatatctgattttaacatttttttctgagacaaatattatatccattttacaggtagacaacgtgagtctcagagaggtttaagtaaaaatttnccttcaggccaagtgaaggc

SEQ ID NO: 4057 - DNA, 1270 bp, Homo sapiens
  misc_feature (4)..(4): n equals a,t,g, or c
  misc_feature (12)..(12): n equals a,t,g, or c
  misc_feature (28)..(28): n equals a,t,g, or c
  misc_feature (78)..(78): n equals a,t,g, or c
  misc_feature (83)..(83): n equals a,t,g, or c
  misc_feature (1225)..(1225): n equals a,t,g, or c
  misc_feature (1227)..(1227): n equals a,t,g, or c
  misc_feature (1235)..(1235): n equals a,t,g, or c
tacncacacctntccttttaggtttatnttcctagccaaacagtgtctgcttttctacccccacttttctatgtcacntttgntttggggaaaataaattatacaaaataccatattatcccatcctataaattactcccggaaaacaagtcatgtgtttagaagctgtgccattaagactgatttcttttgcatactttgtgttacaacacttgtcactattgcagttgttggtttacatgcctgacttcctcaaagaggtcctgagagtagagaatgtgtcttactcttgccttctcttagcctagtttggtatttgacaggaccagagaatagaagtgatagatacaatgataactactattgattgtgtttcttttgtttataggcactgtacatgycacttctacccacattatatctgattttaacatttttttctgagacaaatattatatccattttacaggtagacaacgtgagtctcagagaggtttagtaatctctccaaggtcccacagttgtcaagtgacagaaccaatatgaaggcgttaactgaagaatgaaaggaaggagggaatgtcaagcatttggaagcagtgatttttgtaatggtgtgaaggagttaacaggagaaatagcttggtcttgaacagcctggctgaatatcacatcataggaacacagttgcaccggtgccttaggatgctgagagttctgtraaagtgatctgaaaaattaaacacaaagatgccccatcagtacaaaatgtatgctgggattcattatatcatcatgttaattatttccttctttcttcttccctgttatgctaggatgaaaccaagtccacaaatcttataacagtaattttagtagggattttcttcttccttatccaaaggaaaacgctttcaggaggygtttactccctctccccattcaccctaacttgttcctgttaaagggcccatcatcttctgttgcctaggtaattctagtgcccactgattatctacgaatgataccttcgttgttcatactgcagcgcctctgccatgctaatgtgagataatggtttcttgaagagtgtttgtttccagcctttgcagctcattcaaacttgggagagctctggttgcagcagaaactgcaagcagctggccatatgcattttattgatttattgtattttgcgttacagttgtccactaggtataaggtnanccttaganaacatcatatttatagtaactaggggttgggtttc

SEQ ID NO: 4058 - DNA, 978 bp, Homo sapiens
  misc_feature (15)..(15): n equals a,t,g, or c
  misc_feature (35)..(35): n equals a,t,g, or c
  misc_feature (40)..(40): n equals a,t,g, or c
  misc_feature (71)..(71): n equals a,t,g, or c
  misc_feature (74)..(74): n equals a,t,g, or c
  misc_feature (911)..(911): n equals a,t,g, or c
gggctcggtaaccangggggggagggggggggganaacgngaaaggcttcttttcttccttatcccaaggnaanacgctttcaggaggtgtttactccctctccccattcaccctaacttgttcctgttaaagggcccatcatcttctgttgcctaggtaattctagtgcccactgattatctacgaatgataccttcgttgttcatactgcagcgcctctgccatgctaatgtgagataatggtttcttgaagagtgtttgtttccagcctttgcagctcattcaaacttgggagagctctggttgcagcagaaactgcaagcagctggccatatgcattttattgatttattgtattttgcgttacagttgtccactaggtataaggtgacccttagagamcatctatttatagtaactaggggttgggtttctggagttctatagcaaatggacttatttttacatgtgtattatactaattagaatacagaagattcctggttaaataggaaaatacacctaatacctttttaaatgtttttggaatattgtctgaaactattatatttaacaggcaatagccagccaggaattgcttttttctcccttcattttgyttttaaaccaatttaagaaaaattgatgktttttctcaaaatagatgttgktggatgcagcagaatttttacataaataagccattctagtgtcaaaggaagaattatagaaaaaaatattctgatatgaaaatgctatttcaatattcaagagtmcaaataggaaaggkttcatawtgktggakgttctgcctagcaaaatggttaagaacacaggaggcacactgcatgcttctgaatccaaccttgggcttagcagttgttgttacttgtattttgatagttccaangcagacatgacaattaattgaggtgcccagtagttaatataaataggagatgcgacctaatccccaa

SEQ ID NO: 4059 - DNA, 580 bp, Homo sapiens
  misc_feature (3)..(3): n equals a,t,g, or c
  misc_feature (8)..(8): n equals a,t,g, or c
  misc_feature (13)..(13): n equals a,t,g, or c
  misc_feature (20)..(20): n equals a,t,g, or c
  misc_feature (35)..(35): n equals a,t,g, or c
ganaactnatctnctttggnataacccctttttanatgwttttggmatatctgtcygaaactattatatttaacaggcaatagccagccaggaattgcttttttctcccttcattttgtttttaaaccaatttaagaaaaattgatgttttttctcaaaatagatgttgytggatgcagcagaatttttacataaataagccattctagtgtcaaaggaagaattatagaaaaaaatattctgatatgaaaatgctatttcaatattcaagagtacaaataggaaaggyttcatattgttggatgttctgcctagcaaaatggttaagaacacaggaggcacactgcatgcttctgaatccaaccttgggcttagcagttgttgttacttgtattttgatagttccaatgcagacatgacaattaattgaggtgcccagtagttaatataaataaaagatgcaagattgtattctattgaacatggttcatggtggaaattaacctatgggagcagacaattcttggaaggccaggctccaggcttcattctttcccacagtataggtaatgcagatgct

SEQ ID NO: 4060 - DNA, 888 bp, Homo sapiens
  misc_feature (830)..(830): n equals a,t,g, or c
ctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtgasmcaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggnaaaaaaaaraamaaraaaraaraaaggagatgatgatgcagaattccaccaaggctcc

SEQ ID NO: 4061 - DNA, 776 bp, Homo sapiens
  misc_feature (775)..(776): n equals a,t,g, or c
aatgaaggctttgtggacaacatgacgctgagtggcccagacttggagctgcatgcctccaacgccaccctcctaagtgccaacgccagccaggggaagttgcttccggcccactcaggcctcagcctcatcatcagtgacgcaggccctgacaacagttcctgggcccctgtggcccmagggacagttgtggttagccgtatcattgtgtgggacatcatggccttcaatggcatcatccatgctctggccagccccctcctggcacccccacagccccaggcagtgctggcgcctgaagccccacctgtggcggcaggcgtgggggctgtgcttgccgctggagcactgcttggcttggtggccggagctctctacctccgtgcccgaggcaagcccatgggctttggcttctctgccttccaggcggaagatgatgctgatgacgacttctcaccgtggcaagaagggaccaaccccaccctggtctctgtccccaaccctgtctttggcagcgacaccttttgtgaacccttcgatgactcactgctggaggaggacttccctgacacccagaggatcctcacagtcaagtgacgaggctggggctgaaagcagaagcatgcacagggaggagaccacttttattgcttgtctgggtggatggggcaggaggggctgagggcctgtcccagacaataaaggtgccctcagcggatgtgggccatgtcaccaaraaaaaaaaaaaaaaaaaaaaaaaaaaaaaaaaaaaaann

SEQ ID NO: 4062 - DNA, 1254 bp, Homo sapiens
  misc_feature (1252)..(1254): n equals a,t,g, or c
gagcgaccccgccagtcgggtccatcctgcagtaaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacacctactgagtataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggnnn

SEQ ID NO: 4063 - DNA, 500 bp, Homo sapiens
caggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccat

SEQ ID NO: 4064 - DNA, 1746 bp, Homo sapiens
gggacctgcctcctaatccccttacttctctgtccatctcccttccccagcatcgtgcatctgaggcatttgagatcctttttgaagtctgtccaggccttccttttattcctgtggggccagacaggggcttaggaagggccaaaggaccatcatgaggctaagttgccccagagccccaggatggatgggcccattttttccttattccctgctcagttttttcccctgctccttctctagtccttctttcatatttctccttctcatcttgaaaacaggatgttccctcttcccttgctgtcccatttctcccctgtgtccttatttctcccagtctctatcccctctcaagtccagggcaggccgatgctattggtgcttcttcactttgggacccagttccatatttgtctttagtgtatatcctcttcctgatacctccttcagtccctctctgggccccaaggctgagaatcagtgttaactgggtaaggatcatttgcttcctacccagctcaatctgccctggccatagggcttcccagggaaggaagaagagggaagaatccgaccactttccaatccagtgccaattggcccactaagcatcctaaaggtgaatgtgccctgtgccaatctctcctcaggactgagtcaacccccttcaacctcctcacctctctaaacaccatccatagtaacatgtgcattactggggtacctaggagtcaggacttttgacttcaggccagtcatttcctcccgatggggaaagggtgagatttacatccccaaatgcttgagtccctcagtgaaagaattagtttttgtttgtttgtttaagattttggggaagagatttgaggaggaaagaaaggagatggggtgagagggtttttaagtctgaaactctctgtcatgagctgtccccatggttactcaaggacaaggggggacagttttgcctacagctccagagacacagagaacaaaggggtgaccttcatttttcttcaagccggcctctgtgggggtctgtgagcagcttctactggatctttgtttggattctgtgtctgtatttataatttatttgaaatgtgctgggtagtgttctcatttgggggctgaagttagcaactgggccttcagctagggaaagcagttgcgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagagggctgggcagggccaagtgcctcataggactcatgttctctccaaccagggctggcatcactgctttgcaaagtggggcctgaggtagaagaaggtgtctggtttctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcaggggtggggggagaatgttgcatgttgttttctggtgcttgttattatatatttgaataaacagtgctgcaagtacttgccatgaaggaaaaaaaaaaaaaaagggcggccgc

SEQ ID NO: 4065 - DNA, 1657 bp, Homo sapiens
tgtccaggccttccttttattcctgtggggccagacaggggcttakgaagggccaaaggaccatcatgaggctaagttgccccagarccccaggatggatgggcccattttttccttattccctgctcagttttttcccctgctccttctctagtccttctttcatatttctccttctcatcttgaaaacaggatgttccctcttcccttgctgtcccatttctcccctgtgtccttatttctcccagtctctatcccctctcaagtccagggcaggccgatgctattggtgcttcttcactttgggacccagttccatatttgtctttagtgtatatcctcttcctgatacctccttcagtccctctctgggccccaaggctgagaatcagtgttaactgggtaaggatcatttgcttcctacccagctcaatctgccctggccatagggcttcccagggaaggaagaagagggaagaatccgaccactttccaatccagtgccaattggcccactaagcatcctaaaggtgaatgtgccctgtgccaatctctcctcaggactgagtcaacccccttcaacctcctcacctctctaaacaccatccatagtaacatgtgcattactggggtacctaggagtcaggacttttgacttcaggccagtcatttcctcccgatggggaaagggtgagatttacatccccaaatgcttgagtccctcagtgaaagaattagtttttgtttgtttgtttaagattttggggaagagatttgaggaggaaagaaaggagatggggtgagagggtttttaagtctgaaactctctgtcatgagctgtccccatggttactcaaggacaaggggggacagttttgcctacagctccagagacacagagaacaaaggggtgaccttcatttttcttcaagccggcctctgtgggggtctgtgagcagcttctactggatctttgtttggattctgtgtctgtatttataatttatttgaaatgtgctgggtagtgttctcatttgggggctgaagttagcaactgggccttcagctagggaaagcagttgcgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagagggctgggcagggccaagtgcctcataggactcatgttctctccaaccagggctggcatcactgctttgcaaagtggggcctgaggtagaagaaggtgtctggtttctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcaggggtggggggagaatgttgcatgttgttttctggtgcttgttattatatatttgaataaacagtgctgcaagtacttgccatgaaggaaaaaaaaaaaaaaagggcggccgc

SEQ ID NO: 4066 - DNA, 420 bp, Homo sapiens
  misc_feature (220)..(220): n equals a,t,g, or c
  misc_feature (419)..(419): n equals a,t,g, or c
gggacctgcctcctaatccccttacttctctgtccatctcccttccccagcatcgtgcatctgaggcatttgagatcctttttgaagtctgtccaggccttccttttattcctgtggggccagacaggggcttaggaagggccaaaggaccatcatgaggctaagttgccccagarccccaggatggatgggcccattttttccytattccctgctcagntttttcccctgctccttctctagtccttctttcatatttctccttctcatcttgaaaacaggatgttccctcttcccttgctgtccsatttctcccctgtgtccttatttctcccagtctctatcccctctcaagtccagggcaggccgatgctattggtgcttcttcactttgggacccagttcatatttgctttagng

SEQ ID NO: 4067 - DNA, 635 bp, Homo sapiens
gtagtgttctcatttggggctgaagttagcaactggsccttcagctagggaaagcagttscgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagagggctgggcagggccaagtgcctcataggactcatgttctctccaaccagggctggcatcactgctttgcaaagtggggcctgaggtagaagaaggtgtctggtttctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcaggggtggggggagaatgttgcatgttgttttctggtgcttgttattatatatttgaataaacagtgctgcaagtacttgccatgaaggaaaaaaaaaaaaaaagggcggccgc

SEQ ID NO: 4068 - DNA, 283 bp, Homo sapiens
gctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcttgtgctggtatcaggcatcatcttctcgctggccgaccgctccagctcctccaccatccggatggatgccctggccttcttgcaagggctgctg

SEQ ID NO: 4069 - DNA, 469 bp, Homo sapiens
  misc_feature (247)..(247): n equals a,t,g, or c
  misc_feature (411)..(411): n equals a,t,g, or c
  misc_feature (427)..(427): n equals a,t,g, or c
  misc_feature (451)..(451): n equals a,t,g, or c
gaattccgtattttcttgtaaatactagaatcttattatcaatttctctattttaaaaagcctgatgatattttggtcagtattaagttgaatctctagatcatttttgagagaaatggcttcttataaaactttaaagatgctgttttcctgtcttctcacttgcagtgtctctaatgagcmatatgctgtcatctttaacttttttccyctatatatatgktttttatctgattgctttaaatgnttctctttatcactggttttgagcaatttgattataatatatcttggagtaattttcttcatattttttgtacttgatatccatcgatcttcttgattctgtgtgtttataatattcatcaaattgaaaccattttggtgattatatcttcaaatataatcaantgcaatcatattttgnctctccttctcctctggttagccntcacggcctccaaccata

SEQ ID NO: 4070 - DNA, 473 bp, Homo sapiens
  misc_feature (82)..(83): n equals a,t,g, or c
tatcatttttaaaactattttttctccctatgtttcattttttctagcttctattgctacatcttcaagttcactaaccttnngttctgcaatgtctaactaccattaatcctctcaaatgtatttttcawaaacacgttatagtttgcatctctaatagtttgatttgggcttttttatttcttccatgtctctgcttaacattttgaatgtatgaaatatatttaaaactgtattaatacatttgcctgctaattstacacctttgttaattctaggtcatawmaactgattgattttctttgcgtcattatgggccatctttttcttgttcatttcatgcctgatattttaaaatttaaaaccaaatattgtgaattttaccttgttttgtgttggatattttttgtatttctatcaacaatcatgagttttcttcttggatgcagttacagtcattggaaacaatttga

SEQ ID NO: 4071 - DNA, 539 bp, Homo sapiens
  misc_feature (466)..(466): n equals a,t,g, or c
  misc_feature (513)..(513): n equals a,t,g, or c
gagcgggatcccgttgaggccaggagtctgagacaaacccaggcaacatagtgagacccccatctctacaaaaattagaaaagaaaaaaaaataatgtttcatagattctttattctcagtgctttaagcaggatcagagcccttaccacttttcttgatgacctgggtatgactcaccagactctgcttctgctccttggaccatccatttatagtttctgctgactcttgctargctacctggctcctgtatcctttgttgtggatttttagatcacagttgttctttaagactgaaatttttcaagcactttgaaartcctttttaaagcattattkgttattagtattttcygttacatwtaaaaacaasccaaatttttaaacttattgcctactgcattacaggttwtatyckgttccctttatgtttccagtggatcactttagtcctcgctttattgnttttcaccttccctgatgcttcagaatcatcatgttttgtcagcttnttaggtgacttatagtcttgtcacag

SEQ ID NO: 4072 - DNA, 621 bp, Homo sapiens
  misc_feature (593)..(593): n equals a,t,g, or c
  misc_feature (617)..(617): n equals a,t,g, or c
tttgggtatatggttgattccagggctaagaagggccaaccccaagataagcttggaatatctaatggttccagaaaataagtactcaaaaaattgtgaagmcatgttaaaaggacttaggagccaacctgaaggagcagctaatggccaaagttggaacaactcgaacaaagtaaataagtatagtattggattattactcaataaatgtatgatccatgagtccacactgaaagattgaatagataaagaatagatagttcgagaccagcccggtcaatatgataaaaacctgtctccacaaaaaatacaaaaattagccagccatggtggcatgtgcctatagttccagctattcaagaggctgaggtgggaggatcgcttgatcccatgagattgaggctgcagtaagctgagattgcaccactgcactccagcctcggagcctgggtaacagagtgagacccagtatcacaagaaaaaaaaaaaaaaagaagtgggagagagagagagagagaactagtctcgagagtacttctagagcgaccgcgggcccatcgattttccacccgggtggggtaccrggtaagtgnacacaattcgcggagtatttcccnttga

SEQ ID NO: 4073 - DNA, 1192 bp, Homo sapiens
  misc_feature (6)..(6): n equals a,t,g, or c
  misc_feature (902)..(902): n equals a,t,g, or c
  misc_feature (1041)..(1041): n equals a,t,g, or c
  misc_feature (1054)..(1054): n equals a,t,g, or c
  misc_feature (1138)..(1138): n equals a,t,g, or c
  misc_feature (1145)..(1145): n equals a,t,g, or c
  misc_feature (1166)..(1166): n equals a,t,g, or c
ccaaantgaacataagctgsagctcscgcgcctgcaggtcgacactagtggatccaaagaattcggcacgagccttcatcaattctgggaaattttatctattttcactttgaatatgtcccaggtgcattgtatctattttatgaccatgaaacttatattagatctagatgagacttattctatttgccatgtctcctaaacttttatttctatttctatttctttatatctctgtgaagagttttgatttagttttgtcttttaggtcagtactcttcatgtcagatctaatccactgtttttaccatcaattgcattttaaattataatgattatgtttcactttctataaaatattacagttatctttactaaggtataatttacataaatatataatgtatttagatatatttacatataaatacatacatatttacataaaattaatttcagtgacttcaagggtacaattcatcggatatttatatatttcctatacatataatatatattatacatatttcatgattatacatataatatagcacaatatgcaatatatgtaatacatatgtataatcatgcaatattatatatcataatatataatatattatatatgtgktatatattataaatatatatgtgkaatcatgcaaccaccaccacagtcattgaaaatatttgkatctgktcttctgggaatttttccccctaatcttctgkctcatctttttttatagkatcttgktgstttcacatatttacatttattttatgtattctatcatttaaaaatatttatgttataatgtgcatccagtaaatctataatctgaacctcctttttctttttgagacagagtatcactctgtcgcccaagctggagtgcagnggcgcgatctccctcacggcaacctccgcctcccgggttcaaagaaattctcctgtgtcagcctcaggagtagctgggacttcaggtgcatgccaccacatccggctaattttctttttgtatttttagtagagacggngtttcaccatggntaggctggcttcgaattcctgacgtcaggtgatcaacccgcctctgcctcctgaagtgctgagattacagacttgagccacggngccccgncaatctgagcctcttaatggnctacttaagctttaatttttttttcg

SEQ ID NO: 4074 - DNA, 626 bp, Homo sapiens
  misc_feature (112)..(112): n equals a,t,g, or c
  misc_feature (609)..(609): n equals a,t,g, or c
  misc_feature (619)..(619): n equals a,t,g, or c
  misc_feature (626)..(626): n equals a,t,g, or c
tgggaccagtaaaaccaaatgccctgaagtgttagggtatagataaataaaagcaagggagtctgcttggctggagcagagtgatcatggtgagaggagctcagagctatancaagggtgtactatgtaggcactggaagaaatttggcttttactccaagtggaactggaagcctttggaatgcttccagaatagaagtgatgtcatctgacttatgttttaaatagatcaatctggatgttgtgttgagatagactggaattggtcaaagataaagcagggacaccccaggaggctattatagcaacctagatgacaaagggcagtggttttcatcagaacaatagcagtggaagtgacaggaagtggtcaggtcagattctggaagtatttttaaggtaaagaatmcaggacttgttaatggattgtatgtgggtgtgaaatagaagagtcaagaatgactacattgttttggcctgaacaactgcaaggatagatttaatatgaactgasagagagasagagagagaactagtctcgagagtacttctagagcggccgcgggcccatcgattttccacccgggtggggtaccrgaktagtgtggngattcccgtngaagtcn

SEQ ID NO: 4075 - DNA, 1712 bp, Homo sapiens
cgggatcccgttccaaattcctccctcctgtcccctatatcattgctgtcatttatttgacttatacattagctgtaattattaatacgtcgttacaattaacattttgaacaaaatgttatatgttagattacttaaaaatacaaaaatagaagttttgattttacctttatttattctttttctaacgcttttcctttttattcctaatggttttttgtttgtttttgtttctttatatttttagtgactgaattaacttattagcaacaaggctaatggaaatcacttgagcctctctaagtctttctcctcccttgacacatttggaggactgagggaactaagtgatttctaatgtctttccagctctatttttcagtgattttagtttaggctttttagttctttcatttcttacaagatttgcataccaaattgttaattaaaaacaatccacattttatcctatagttgtctagaatgttcattgtcttctcagttctcttgctttttttccaatttgccatctgccagtttgctgacttggcaatatttccactatccatgtgccagctttgcaacctctcagcaaggctcgcagctccttctgcacgatttgagggtcttggcataaataggaccaggaaggcagagggaagccttccaaccactgcagtgcaattgctcccctataaaagccaagcagttcaggtccagcatcctcaggccgtgattgtagataaactctctgtgatttcattgaggagtatttgtatagatcagctgaaattcatggagatggaaaacattattaaacccggttatgtgacttcttgaagttacattgtgagttatgaaggctgcattcttttaaatgggttttggaatttagttgtgatgaacatttgaggatttagaaatagaaaaataaattgtgtaaacccttcgctttctgtctgcatgcgtgaagaccacatagatagcttgtttgcttttgctacagtctcattgacttctctgccctcgtcagtcttcctctccatgttttccccacttatctttcttacttcagtgcagaatttctttctttattttaatgtctatctagttttttattatttctatcagtgctttatagatttctcagcttagttttgccttggacaacttcttctctattcacaggtatcagctgggattgacaagggttagtttcttcgtggaaaaaaaaaatgggagctaaactgactgatggaagcagctgccactaatagactttggtttttgttttaatcttcatggaagggtttagtttgcaaattcttcctgcttggatatttaggagcctttcctaaggaagggaccagaattattttctttatgtaaaattttatatgtgtttaaaattctgtcctctgtgtgtgtatatgtgtagtacatatgggtataactggccttaggaaataggttcaagtgcttacacaatattatcagtctaatattttaaacatattatctcaagttatttgtttgagtatagtatactttgaagggttcctcagcttcacttttaacctattttttatttctatttcctctacagtagcattatcctatagttatcctgatatccatttaatttcagaaggactggatattactttagtcaagatgcagtctgatttaattttatttttaaaacaaacagc

SEQ ID NO: 4076 - DNA, 770 bp, Homo sapiens
  misc_feature (43)..(43): n equals a,t,g, or c
  misc_feature (48)..(49): n equals a,t,g, or c
  misc_feature (708)..(708): n equals a,t,g, or c
  misc_feature (731)..(731): n equals a,t,g, or c
  misc_feature (738)..(738): n equals a,t,g, or c
  misc_feature (762)..(762): n equals a,t,g, or c
gctcgcgcgcctgcaggtcgacactagtggatccaaagaattnggcannagcgggatcccgttccaaattcctccctcctgtcccctatatcattgctgtcatttatttgacttatacattagctgtaattattaatacgtcgttacaattaacattttgaacaaaatgttatatgttagattacttaaaaatacaaaaataraagttttgattttacctttatttattctttttctaacgcttttcctttttattcctaatggttttttgtttgtttttgtttctttatatttttagtgactgaattaacttattagcaacaaggctaatggaaatcacttgagcctctctaagtctttctcctcccttgacacatttggaggactgagggaactaagtgatttctaatgtctttccagctctatttttcagtgattttagtttaggctttttagttctttcatttcttacaagatttgcataccaaattgttaattaaaaacaatccacattttatcctatagttgtctagaatgttcattgtcttctcagttctcttgctttttttccaatttgccatctgccagtttgctgacttggcaatatttccactatccatgtgccagctttgcaacctctcagcaaggctcgcagcttcttctgcacgaatttgagggcttggcataaataggaccaggaaggcaganggaagcctttcaacccctgcagngcaatgnttccctataaagcccaagcaattnaggtccag

SEQ ID NO: 4077 - DNA, 622 bp, Homo sapiens
  misc_feature (613)..(613): n equals a,t,g, or c
  misc_feature (617)..(618): n equals a,t,g, or c
cacaggtatcagctgggattgccaagggttagtttcttcgtgraaaaaaaaaatgggagctaaactgactgatggaagcagctgccactaatagactttggtttttgttttaatcttcatggaagggtttagtttgcaaattcttcctgcttggatatttaggagcctttcctaaggaagggaccagaattattttctttatgtaaaatttwatatgtgtttaaaattctgtcctctgtgtgtgtatatgtgtagtacatatgggtataactggccttaggaaataggttcaagtgcttacacaatattatcagtctaatattttaaacatattatctcaagttatttgtttgagtatagtatactttgaagggttcctcagcttcacttttaacctattttttatttctatttcctctmcagtagcattatcctatagttatcctgatatccatttaatttcagaaggmctggatattactttagtcaagatgcagtctgatttaattttatttttaaaacaaacagcagtacttctagagcgrccgcgggcccatcgattttccacccgggtggggtaccrggtaagtgtacayawttcgggaagtwttcncgtnntgcg

SEQ ID NO: 4078 - DNA, 964 bp, Homo sapiens
  misc_feature (62)..(62): n equals a,t,g, or c
agcaaaagctgcagctcgcgcgcctgcaggtcgacactagtggatccaaagaatttggcacnagttctctctctctctctcgcttcttccagatgttagtcttgctatctcttttggctagtggtggtctgccccttcttttagtgggggatgtattagcttcaaaatcttcaacagtgcttttccttcctggcgactcttctccagggtgctccatgatcactccactccctccatctaggatgtgccttaaagctgggtcctcaggggaacagacggtggttccactctcactgctgcttaggtctaaatcttctaagtaaaggatcttgggctgatgcatgcttttgatgaatgttttctccctctcgagctttctacttgartgaagctcattcatgtccaccccagagtccagactggtgtcattgctctgggttctcttgccctttttcaggtctataaaggagtgcctcacttgtgcaactggctttccatcaagagacacaaaccaggctctgggatgctgggagggctttcctttggacagctccagragggtctgttctgaaattccttgaagttccgatgaaaatggagtcattacaacagcctcatttagtgttccaggaacagagacggattccagtaagctgcttgagtatcggctccaatctgaagcctgggatggcaggctctgttgaccttcaagtatgatatcctcttccctggcatctgggggctgtgcatgagaatgaattggcattttgggcaaggtctgcgtaaagttctctcgatttactggttccatcaattggccatagactaactgtccctttcttggcaaagtagctgacttagcagtatgtaattgttccggtgtggagaaaaggtcagatgtttgaaggatggcaatgggttggctgtaaatatgcataagctgttcaggaatatgggaacgccc

SEQ ID NO: 4079 - DNA, 546 bp, Homo sapiens
  misc_feature (519)..(519): n equals a,t,g, or c
  misc_feature (523)..(523): n equals a,t,g, or c
  misc_feature (525)..(525): n equals a,t,g, or c
  misc_feature (531)..(531): n equals a,t,g, or c
tgcaataacaaagtagtacagcaaaaaatccaatgacaatgactattgttcctcctaatatggctgtaagaaacactgtgtggtaggcagttatgtccttggaatcttcatttatacctgaacctacatggttcaatataaacaaagagaaaatgttattttagatcaaattctcaactatgtcacatcctgggtgaggcaaattgaataagtgtacatacttttatttgtttgcccccctcctatgacagatttccctatgggtgaagtaaaccttccctatcctttggcttaattgactgactcgctttaaccaatgaaatgtgagcatattaaatgagtttgcatggtgtggctctgccctcttgctcaagacttctaatatgtgaatagcatagcccagagagttgttattccttcaacctggggtctagaatgagaatatctgttgaamtraaaraagccaagtccaacagcgcagcagacaatcctgaaacactcaggaarggttacgtaaantaangngaaggncttcatcgcccgacg

SEQ ID NO: 4080 - DNA, 609 bp, Homo sapiens
  misc_feature (579)..(579): n equals a,t,g, or c
  misc_feature (591)..(591): n equals a,t,g, or c
  misc_feature (603)..(603): n equals a,t,g, or c
  misc_feature (609)..(609): n equals a,t,g, or c
ccactcatgaaatgttaagtagcaaataagcgtttgatactgttagccaccgagacagcagggttgtttgttmctgcagcaatggatatgacagaagatgctgagatgctgctatagaaagcttaaaacatatgacattggcttctaggccaggcagtgagaaaactgtttcaagaggccgtaaaactggtgacccaagtamcaaaaaaattggtaaaataaactgggcgaaaatatttttaactaacttgagctttgtgcaaagagattttaagatagaatgttgattatcagctgcatttattttttatctagatatttaatctttaaatattttaaagacaaattcaaaaaaaggatttaccaaattaagcaggggtctaaagaaatagaatacaaaaattctaaaacttgaagcattaagagttgcagctccttctacctgggctctagagtgaacagagcacaactgaccaactatcctcctgctatgagaacatacgtatacgaatgccattgtgataagagtacttctagagcgaccgcgggcccatcgattttccacccgggtggggtacngggtatgtgggnaattttcgcggnagtatn

SEQ ID NO: 4081 - DNA, 1297 bp, Homo sapiens
  misc_feature (1104)..(1104): n equals a,t,g, or c
  misc_feature (1131)..(1131): n equals a,t,g, or c
  misc_feature (1183)..(1183): n equals a,t,g, or c
  misc_feature (1249)..(1249): n equals a,t,g, or c
gagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgkctgcactgaactctgggtggaaaaccatctatcaggtggacctcccccacacggcgatccaggaagccttcaacaagaagaaattcgaggatgccttgagcctcatccacagcgcctggcagcggagcgacagtctctgccgcggncgagcctccgagacccctggtgctgangcagaactggttggcgtccctggtggcaggaaaggaagcacgcagccggcangcacactgcacggctgtgcatgctgtcggagctaagtcacctgcctgggcggaaaacaccgagtgnggttaagaaggtcctcatcagggatcagacagtgccggacctggatct

SEQ ID NO: 4082 - DNA, 2550 bp, Homo sapiens
  misc_feature (1190)..(1190): n equals a,t,g, or c
cgaccagctcaacgggcagctggaccccagcacctggtgctcccgtgctgagcccccagaccagtcctttcggaccggctctcccggggatgccccggagaggccgccgctttgcgactttagtgaggggctttcagcccaatggacttctaccgctttaccgtcgagagtccaagcactgttacatcaggtggcggccaccatgaccctgcagggcttggccaaccgctgcatgttcctagtagccctgaggmtgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtarcgctgargattctggggtggatgagggacaggggagcccttcggagatggtccattcctcggagttcagagtagacaacaatcacctgctcctgctcatgatccacgtgttccgagaaaacgargagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacrgatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcancgacgtcatccctctgctctcsgtgawcatggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaaggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaaaaaaaaaaaaaaaaaaaaaaaaaaaaaaaaaaaaaaaaaaaaaaaaaa

SEQ ID NO: 4083 - DNA, 1913 bp, Homo sapiens
  misc_feature (1286)..(1286): n equals a,t,g, or c
tcgacccacgcgtccgaagacctcatccagctcgtccaaaggcttcagrgatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcrtgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaawccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcatgacttttccattacatctgaggattccagagtcctctgttcatccctggggatagagtgagccctcttgcgtcttccagggtagctcaggttggcccagtttgggcagntccatttttggaggtcactctttccsscctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctytgtttgctttaaataactytttacaaataagggttcgggcacgtggttcaag

SEQ ID NO: 4084 - DNA, 617 bp, Homo sapiens
  misc_feature (601)..(601): n equals a,t,g, or c
  misc_feature (612)..(612): n equals a,t,g, or c
  misc_feature (616)..(616): n equals a,t,g, or c
gtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataacyctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaaraaaaaaaaaattccttaagccaaatggtgttccaagttggttgctgtgacaacttcccaggaggggnccctttgttancccnt

SEQ ID NO: 4085 - DNA, 1048 bp, Homo sapiens
tctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggcctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccytccctcacccatattgcatgcccccccgccattcccttacacctaccccacctacaactgaagacaatgcactttacagatatcacccacacacacctcgctggggcaggggcaccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggaraggagctggggttcaggcattgtcttttttcctccttgtatataagaatgtatatttgatgcctcataaaagaccttgtgctcamaaaaaaaaaaaaaaaaaaa

SEQ ID NO: 4086 - DNA, 2510 bp, Homo sapiens
  misc_feature (36)..(36): n equals a,t,g, or c
  misc_feature (39)..(39): n equals a,t,g, or c
tgcgactgcaggtcgacactagtaggatccaaatgnggnggcacgagtccattctcctggtgtctctggatctgctccccacctccatcctcctggtgtctctgtggatctgctccccacctccatcctcctgggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagytcgytacgttgacgtcctgaacccaagcgggacccagcggasgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccytagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcgctctgcccgctgttctggggtcgactgccacgacttttgattcaagaagcttcctccaggcgggagcggctatttttcctaaatgagaattgttacattgcaaattgttgaataaaatattttgcgctccttcaagcaaaaaaaaaaaaaaaaaaactcgag

SEQ ID NO: 4087 - DNA, 641 bp, Homo sapiens
  misc_feature (7)..(8): n equals a,t,g, or c
  misc_feature (18)..(18): n equals a,t,g, or c
  misc_feature (64)..(64): n equals a,t,g, or c
  misc_feature (634)..(634): n equals a,t,g, or c
caccttnntttaakgccncactgtgcaagctgccccgcctgccctcccagggcctcctkkagtnccyktgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtgcactccctggctctgaactcccctcctccaggcctgagggttcccagggaggagaggctcctggcgacctccctgctgcagggggccctcccagcggggccatgcccttctacaaccctgctcagctggcacaggcctgcgmcacctccgggagctcaaggctagggaggattggccagaggaagcacctggtgctgaactaggcttgccctgctgtgaacttgcacttggagccctgacgctgctgttctccccgaagaacccgaccggaaaacccccccctttttcnccccccc

SEQ ID NO: 4088 - DNA, 1036 bp, Homo sapiens
tctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagcckgytctcgctcygcggactttgtcgctccactccagcctgggtgacaagagcaaaactccatctcaaaaaaaaaaaaaaaaaaaaaaaaaaaaaaaaaaactcgta

SEQ ID NO: 4089 - DNA, 1859 bp, Homo sapiens
  misc_feature (1185)..(1185): n equals a,t,g, or c
  misc_feature (1230)..(1230): n equals a,t,g, or c
ggttcaagcaaataattctattgtgaagatgcttggccgggatctgtgcctcctgccccagactccagccagtactgcccaggggagagtctgagtcgttctcctaatgagagcttcccaggagatctccgcctagcaagtgcaaaaggcattgactggcctgtgggacagttaagaaacggtagcagttactccctttccaccttcacggcccaggagttcgatagcagatgaagacggtgagtcttcttctaaccctatggttctcccaaactttctcctttaacttattttttgccccacctcattctcttcttcagagttctatttttttctctgtgtcttctataactactgtacaccctatcctggtctttttttttgcattctttagaacttgattgccacatctgtaatcccagctactcaggaggtcagggcagggggatcacttgagcccaggattttgaggctgcagtgagctacgatcacaccactgtactccctccagtctgggcaacaaagtgaaaccctgtctcttaaaaaaaaaaagaacttgatggcctttaactaaaacatagacagctttgtaatgctttcccccaagctctctgggcttcctgacgtccttgcccttttgtttgttcttcctttcccaccccacccagactcagtacccaactctacatctgtgtcttttcccctgactactatttttgttcatgggggtcatgtatgactatctttacccttttatcctttctcttcctaagtgtggggggtaaagccagaggaggatttaggttgagcagtggaagaaagattgtgtcaaaaatgagccattaatatttggaaaattgttttaagtttaaaggcctgagaaatgcataaaattgaaatttaattgatataggcaagtggttatgcaaatgatttttgcccatcctcccattttagtcaggcaattttttagaacaactttcaaccagtactttcttcagttgtctttgagatttttataaattaaagaaaaagaaacaggaaaaaaaagtgatttggaagctcatttaaagtcactgtggttgaaaaggcaattatgtggctcctggcagttgtaggagagtggctgtccccaaatcgagctaccaaggacagattgccaaagcccaagaagaatcattgtgnaaacattagagctcagctggaccttcagaggcctaagtgagttgnttaccctgtgtaaatcccatgcagtgttacagcttcctgcaaatcactggcataggaaggtctgagtgttgctgccaaggtttgatgtctgctgcttggagctctgaggagcacaattagcatgtggttccaccatgagcagaaaccacaagatttctgcacagctgagcccactctagcattgttttaaagggcctttggagaaatactgaaggccgagcttcaggtgctaggtaatagacaatttgagaaacatttcatttaatgtgtcttaactatattgagcacacttgtcccatttggctggctctagtgtggagaaatgcagacatgctccttacactgttttcccattccttggtatttctaactgcatacccatcatccccagtgttgacttagcctcccaggagaaggcagcaaggaacagcaactattaatagaaggtgtagaggccgggcagtggctcatgcctgtaatcccaaagtgctggggttacaggcatgtgccaccacgctcaaccagtatttctcattttcttctaataaaccttctagagttccacattagaaagctctagatagaaacattttttaaagagctcaggcttaaaaaaaaaaaaaaaaaaa

SEQ ID NO: 4090 - DNA, 459 bp, Homo sapiens
  misc_feature (24)..(24): n equals a,t,g, or c
  misc_feature (39)..(39): n equals a,t,g, or c
  misc_feature (377)..(377): n equals a,t,g, or c
  misc_feature (379)..(379): n equals a,t,g, or c
  misc_feature (413)..(413): n equals a,t,g, or c
tgcgactacacggcgacactagangatccaaagactttnccacgaggttcaagcaaataattctattgtgaagatgcttggccgggatctgtgcctcctgccccagactccagccagtactgcccaggggagagtctgagtcgttctcctaatgagagcttcccaggagatctccgcctagcaagtgcaaaargcattgactggcctgtrggacagttaagaaacggtagcagttactccctttccaccttcacggcccaggagttcgatagcagatgaagacggtgagtcttcttctaaccctatggttctcccaaactttctcctttaacttattttttgccccacctcattctcttcttcagagttctattttntnctctgtgtcttctataactactgtacaccctatnctgggtcttttgttttgcattctttagaacttgattgccacatctg

SEQ ID NO: 4091 - DNA, 994 bp, Homo sapiens
  misc_feature (21)..(21): n equals a,t,g, or c
  misc_feature (66)..(66): n equals a,t,g, or c
  misc_feature (248)..(248): n equals a,t,g, or c
  misc_feature (387)..(387): n equals a,t,g, or c
  misc_feature (970)..(970): n equals a,t,g, or c
  misc_feature (972)..(972): n equals a,t,g, or c
  misc_feature (974)..(974): n equals a,t,g, or c
  misc_feature (976)..(976): n equals a,t,g, or c
  misc_feature (994)..(994): n equals a,t,g, or c
atgggatttacacagggtaancaactcacttaggcctctgaaggtccagctgagctctaatgtttncacaatgattcttcttgggctttggcaatctgtccttggtagctcgatttggggacagccactctcctacaactgccaggagccacataattgccttttcaaccacagtgactttaaatgagcttccaaatcacttttttttcctgtttctttttctttaatttataaaaatctcaaagcanctgaagaaagtactggttgaaagttgttctaaaaaattgcctgactaaaatgggaggatgggcaaaaatcatttgcataaccacttgcctatatcaattaaatttcaattttatgcatttctcaggcctttaaacttanaacaattttccaaatattaatggctcatttttgacacaatctttcttccactgctcaacctaaatcctcctctggcttawaccccccacacttaggaagagaaaggataaaagggtaaagatagtcatasrtgacccccatgaacaaaaatagtagtcaggggaaaagacacagatgtagagttgggtactgagtctgggtggggtgggaaaggaagaacaaacaaaagggcaaggacgtcaggaagcccagagagcttgggggaaagcattwcaaagctgtctatgttttagttaaaggccatcaagttctttttttttttaagagwcagggtttcactttgttgcccagactggagggagtacagtggtgtgrksgtrgstcactgcagcctcaaaatcctgggctcaagtgatccccctgccctgacctcctgagtagctgggattacagatgtggcaatcaagttctaaagaatgcaaaaaaaaagaccaggatagggtgtacagtagttatagaagacacagagaaaaaaatagaactctgaagaagagaatgaggtggggcaaaaaatgggttaatngncnanatttggtaggagaatttn

SEQ ID NO: 4092 - DNA, 1000 bp, Homo sapiens
  misc_feature (953)..(953): n equals a,t,g, or c
caagaagaaggaccaagcagtagggaagtctgggctgttaatccctgcagtttacttgtgccgtccagacctgcttaagcccagtcttgcttttactgtaccaagtggattactgctgtacatgtccagttttatgattcagtgaaccagcaatactctgttcacgatgggctgttgtttttacatagtctcttggttttccataggcggtcattgcatctcttcctgggcctagtaacaagccaggaaccacagacagtgattgctggcaaaccctaagggtctgaaactcttacccttttcttggtgcttgttagagagaggggtccttaattcattcctgtttgccatgtcatttccagtactactgggtgtgctgaggcataggctcaagggttagggcagctttcattgctctagaaccttctcttggaatgggcttcagtaaaaactggcaggctcataggttacccagtaaatgggtcagaacagcatatccaagtattgaaactcactatttgttttacctctttctcagtggaagtggtgcaaggtgtagttatttctctcacttgaggtgggatatcctgggtcagaccagggaaatcctagaagccatcagtgtagtgaatccctgaactttcatgagttttwttccatcctctggcttgtgtatgtgtcttacacaggtgtccaaggtgcttgstagtttttgttcaccaggtccagttaagataatggtatccatgtgatggaccagtgtggtgatctgtgggctgtcaagatgatcaaggactctccagactatattatggcaattcagacatagccctcaggtgagacaatgaaggtatactgcctttctgccacttcatgcaatttgcatctcattgtccttactgatggtgatagaaaagaaggcatttgccaggtcagtagtcataccagatgtnccgggattatgctaattttattcaaaaaaaaaaaaaaaaaactcgag

SEQ ID NO: 4093 - DNA, 1313 bp, Homo sapiens
  misc_feature (1274)..(1274): n equals a,t,g, or c
  misc_feature (1286)..(1286): n equals a,t,g, or c
  misc_feature (1294)..(1294): n equals a,t,g, or c
gaattcggcacgagctcgtgccggagcagcccacaggacctggccaagctgcagagaatgtcaccatccagactgtgtcctatggggtacaagaggagctgcgggaccaggaggatgaccaggaggaagaggagagcgatgccacttcaacggagagtgaaagtgaagacaacttcctcacgctgcctcccagggaccacctggggacttactctcttctccatgctctgctgcttctggccactgggcattgctgccttctacttctcccaggggaccagcaaggccatctccaaaggggacttccgcctggccagcaccacytcccgccgggccctcttcctagccacaytcgccatcgccgtgggggccggtctctacgtggctgtggtggtggctctggcagcttacatgtcccagaacggtcatggctagtagccagtagggcctgcatcctgactcccctgcccacctgaggaagcagtggggcttggagttgcagaccctatggaaaggcccggcccctgaagatgatcccgtgagagtggcttgctgagggggagacccccattccacagcctgcagagctcagccttcacttctgcttgcccgctgctcccagccccagagcagggcccggggcgccactctctaacccaggctacagacgggaaacagaaggcagggctgcccaccaggccatcccagcagggcctagctccatccattctgcccattccctagaggatctcctgccctacagccagcccaccacctaccctgscaacctycccacagagaaagagcaggaggttacagggagaaaagggggtgsccagagcacaaggggacccgtccaatcctttcaagccacagggatcttcacctggggacagsctgagcttccccaactycactgtctggccccatcatgsccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggtccttggagcttcttcatgcgggtgcaaaaggcagttgcaatgacagagaatagagggtcctgaaatattgctgtactacatgactcttcctactctccccccactccccgcccctatcatccttttctggggctttgctggggggtccgtgagctggtgccatcacaagtagactagncccagagagtgnccctcagnttcaccagccacttaggcg

SEQ ID NO: 4094 - DNA, 814 bp, Homo sapiens
aggtgcctcagctcaccagccactgagcgcagggccctaggtccagccctacagaaaacgcagcaaggagagaccctagggagtagtgagtatagatgagggaagggactcagggaaggaatggcctgctgagtagtcagcggtgcttaggaaggcttcctggaagaggtatcccttgagcaaggcctaggatgaatagaattcatctgagggatttggtcmcataactctttgtatttgtaggcagggatgtggcagkaaccttccatgggaagcttccaggctgtttggattctgcctggaacatctgggctggagccaaactacagccattcctaagggttctgccaactcaaggaggaacgtcacacctgtctctcaaagaccaatgatgttttcccatctctgaatgctagggggtcagtggtgggtacctggttacccctggggcatcttcactgatayctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacaaaaaaaaaaaaaaaaaaaaaaaaaa

SEQ ID NO: 4095 - DNA, 2005 bp, Homo sapiens
ccacgcgtccgcctctacctgtgtaccacggcctgggatggaccctgcagctgtggccctcctggcactatccctaccctgtgccctggtgggtgtgcagtgggaacaggcaccctggggtccttggaggctcagcctcctcagccctcacccccgagaccccatcgtggcgcctgtgtccactcagggattatcccaagcctggccagaggtcgggaggggacagagggagccacataggagcctctaccagcccctttcttaccacagggtgggggcgcttccctcccacagggtctcaggcttgtgggctccccccagctgcacaggccccagagggcacttctgacccttctctttggggtctgccctggggggctccaggccacttgctccaccccatccctcttctggagcctcccagcacctcagttccgactgtggggaaaacagaaccctaggaagcaacctcacggctgtgggcaggggagggcggccgggagccccagctgccccacagggacattgagtgaaggcagagcctgggagggaagtcagatccgtgcatgggtcccttcctgttggtgttggcgtccctgagtgagcagccatccgccgccccctggaaagagacctggagaagcagcttcaagctttggagcccagcccagctgctagcagcccctgggtcacagtgcgaagggggaaggcaggggcttgaggaagaaagtgagaggattgtgcctgggggcccctggagggccagtctggaggcgcgttggggtgaggcggtgctggctgtgcccgtctgagatgggcagagggaaggcgcccagggctgagcccagggtccccaggccagtccctcactgctctggggttcagtttcctcacctgcacaaagggcgggtcccgtgctctccggaggccacacggggtctccctgaggcactgagtctggcttgtttctggaaactgaggcacaggaggacgttgataaccggccttcctctgttctctttcccaggggtgcagctcgtccgtcccatggtttcagatttgcccggtgtgttgcaaccaccacctggcactcagcttgcccggtgccgcctggccccgcagcctttcccaggccttgcaagggtggcacagatggggaaactccatctgcaggggcgtcacccccgagggatgtgtcctccacactcccttgatggtcacgtgggtcccgggagggcgcgtgtgactcttcccaggattgcagcgttggggcgttgtgccagcctggccccgtgggtgcggagtgccgtggacccctcggccctcccgaccttgtttccctttgatgtagaagtctgcatggcatgaattccagtgacaatgggccgggccaggctccctgtgcccctggtactgctgcccagggccggtctctgcagtcaccctccttccttcctggtggctcctccctccctcctttgttcttcttttcctgcctaaatgtttatcgagtccctcctgcattaagtacccgtgctgtgcaacaaattaccttgaacttggtgacttcaccaccactgcatgtcagcgcccagccgtagacgagggtttgggaggcatggctgggcctgcccagggctccctggctgaagtgggtgctgaagctgccaggcactggaggctgggcctctcgcacactccctggctgttgggagggtgcattcttctttcttccttgtcttctagaggatgcactcttggctgtaggcctcccgtttctctcacgggctattcctggggttccctcagatcctggaggtgcccacagcccccttccccgaggctcccccccccacacactctgcgtccgcagaggtttgtgagggtccatgaaatacttgagttaccaggatgttcattttgcaacattttcaacatttgtaatccagtgaaatatcaataaaaaccccacagggttctggtaataggaaaaaaaaaaaaaaaa

SEQ ID NO: 4096 - DNA, 364 bp, Homo sapiens
  misc_feature (361)..(361): n equals a,t,g, or c
ggtcgacccacgcgtccgcctctacctgtgtaccacggcctgggatggaccctgcagctgtggccctcctggcactatccctaccctgtgccctggtgggtgtrcagtgggaacaggcaccctggggtcsttggaggctcagcmtctcagccmtcacccccgagaccccatcgtggcgcctgtgtccactcagggattatcccaagcctggccagaggtcgggaggggacagagggagccacattaggagcctctaaccagcccctttcttaccacagggtagggggcgcttccctcccacagggtcttcaggcttgtgggctccccccagctgcacaggccccagaggcaattttggaanctt

SEQ ID NO: 4097 - DNA, 754 bp, Homo sapiens
  misc_feature (60)..(60): n equals a,t,g, or c
  misc_feature (103)..(103): n equals a,t,g, or c
  misc_feature (150)..(150): n equals a,t,g, or c
ccgactttgtttccctttgatgtagaagtctgcatggcaatgaattccagtgacaatggnccggccaaggctccctgtgcccctggtactgctgcccagggcnggtctctgcagtcaccctccttccttcctggtggctcctccgtccancctttgttcttcttttcctgcctaaatgtttatcgagtccctcctgcattaagtacccgtgctgtgcaacaaattaccttgaacttggtgacttcaccaccactgcatgtcagcgcccagccgtagacgagggtttgggaggcatggctgggcctgcccagggctccctggctgaagtgggtgctgaagctgccaggcactggaggctgggcctctcgcacactccctggctgttgggagggtgcattcttctttcttccttgtcttctagaggatgcactcttggctgtaggcctcccgtttctctcacgggctattcctggggttccctcagatcctggaggtgcccacagcccccttccccgaggctcccccccccacacactctgcgtccgcagaggtttgtgagggtccatgaaatacttgagttaccaggatgttcattttgcaacattttcaacatttgtaatccagtgaaatatcaataaaaaccccacagggttctggtaataggaaaaaaaaaaaaaaagggcggccgctctagaggatccaagcttacgtacgcgtgcatgcgacgtcatagctcttctactacgtgtatccc

SEQ ID NO: 4098 - DNA, 564 bp, Homo sapiens
ccacgcgtccgcccacgcgtccgatcatggctcattgcaaccttgaattcctgggcacaagtgatcctcctgccttagcctccccagtagagctgggactacaggtatgcgccaccacacctggctaatttttttaattttaatttttgtagagatgggggggcaggtctcactatgttgcccaggctgttctcgaactcctggccacaagccatcctcccaccttagtctcccaatgcgccggaattacaggtggctcaggtgtgagccaccgtgcctggcttttctccactatcttgaaatcagatgggaggaggcttttttctgggtgggactgaggaggcacactgaagtcccccaggtcatcggggctgggccattgcctttttccccaccctgggtagtcgtggacagaagcttgggatgggatggagaggagagatcgtgctgtgtgtcatgtctgttgttcaagtaaataaaagttgccctgacttcaaaaaaaaaaaaaaaaaaaaaaaaaaaaaaaaaaaaaaaaaaaaaaaaaaaaaaaaaaaaaaaaaaaaa

SEQ ID NO: 4099 - DNA, 681 bp, Homo sapiens
ggcacgaggtgatcttggctcactgcaacctctgcctcctgggttcaagcgattctcctgcctcagcctcctgagtagctgggcttacaggcacccaccaccatgcccggctaatctttgtatttttagtagagacggggtttcaccatcttggccaggctggtgtgatcatggctcattgcaaccttgaattcctgggcacaagtgatcctcctgccttagcctccccagtagagctgggactacaggtatgcgccaccacacctggctaatttttttaattttaatttttgtagagatgggggggcaggtctcactatgttgcccaggctgttctcgaactcctggccacaagccatcctcccaccttagtctcccaatgcgccggaattacaggtggctcaggtgtgagccaccgtgcctggcttttctccactatcttgaaatcagatgggaggaggcttttttctgggtgggactgaggaggcacactgaagtcccccaggtcatcggggctgggccattgcctttttccccaccctgggtagtcgtggacagaagcttgggatgggatggagaggagagatcgtgctgtgtgtcatgtctgttgttcaagtaaataaaagttgccctgacttcaaaaaaaaaaaaaaaaaaaaaaaaaaaaaaaaaaaaaaaaaa

SEQ ID NO: 4100 - DNA, 865 bp, Homo sapiens
ggcacgagagcagacctgagtgccaacggtgtgacctcaggcctctccaggtctcagtttccacatccgtgtaaatgggtgtgatgagagggtgacgaagaagggccatgacggggaggccacggggaagccaaggggttggggcaggactggtcacagtggctccaagtgcccattcaggcagtagcaatggggttgaggtccctaactctctctccagtgtgatgttcttggtgcatgggggtgcctggggtgctcccaaggcctccgcccgccacctctgtctctccctgggcctccatccttccacctggctctggaatcacaaccggtggtagccagtccccaggacagctccagtcccttagatagtcaccctcatgagcccacccagcctctgggttgacatacacacccccagcagcccctagctgcctctggctgacatcaactgaggacatggggcctggaacctgggaaacagctacctcggggaatgctgttggtgagggccaggctctgggttcccatcccagctgcttactaagaatcatggggtgtgtaggccgggtgtggtggctcacatctataatcccagcactttgggaggctaaggtgagtggatcacctgaggtcaggagttcgagaccagcctggccaacatggtaaaaccccctctctactaaaaatacaaaaattagtgggcatggtggtgggcgcctgtaatcccagctactcgggaggccaaggcaggagaatcacttgaacccgggaggtggaggtagcagtgagctgagattgagccattgcactccagcctgagtaacagagtgagactccgtctcaaaaaaaaaaaaaaaaaaaa

SEQ ID NO: 4101 - DNA, 2631 bp, Homo sapiens
  misc_feature (2619)..(2619): n equals a,t,g, or c
ggcagagccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgaagcagctcatcgataagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggkatttttttcacgtgcctgagaccagcctggtaccaggaccttttgttcacagcgtgcagcagcgagccggctgcagtgygtctcccctggcctcgccttctgcaaaccaccgcagccaccacagcgtcagggtggagatctgggtttctagacctcactgaacacactgraatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacactkgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcarcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggtttttyctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaaaaaaaaaaaaaaaaactcgagggggggcccggtacccaattcgccagagagtgncaatggcatcaa

SEQ ID NO: 4102 - DNA, 3486 bp, Homo sapiens
cgggtcgacccacgcgtccggcgcgggctgcagacggctgcgaggcgctgggcacaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcaytgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtcaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagctgtataatgagatagaaaaacrtcaggtatggaaggctttcagttttaatatggctgaaagcaaaggataacgaattcagaattagtaatgtaaaatcttgataccctaatcttgcttctggatctgttctttttttaaaaaaacttccttcaccgcgcctataatcctagcactttgggaggccgaggcaggcagatcacggggtcaggagatcaagaccatcctggctaacatggtgaaaccccgtctctactgaaaatacaaaaaattagccgggtgtggtggcgggcgcctgtagttccagctactcaggaggctgaggcaagagaatggcatgaacccggtaggggagcttgcagtgagcccagatcatgccactgtactccagcctaggtgacagagcaagactctgtctcaaaaacaagcaaacagacttccttcaacaaatatttattaaatatccactttgcaacagcattgaaatggctgtaaggactcctgagatatgtgtccagcaaggagtttacagtcaaacaggagagacatgcctgtagttacatccagtgtgatgggtgctgagaggcaagtacaaaccacgatgagaaaaaggagaggaggggaaatgcagagcttgccctgtagaaaaagcacatcccaggtagagagggtagcacattaaaaaatgaaagcataaaaaaatacggagaacttaaaaagattaagttctacaaactgataaaagtgagttaggaccaagttgatgggccttagagaccaaataatactttccgtgtgcatagtatttttcagattctgagatgcaccctatctcatttgattctcacaaccgcttgtaatgtgtaagagcatgaggtctttcagaaaagctggctggcctagcagggcgcggtggctcacgcctgtaatcccagcacttttggaggccgaggcgggtggatcatgaggtcaagagatcgagaccatcctggccaacatggtgaaaccctgtctctactaaaaatataaaaattagcttggtgtggtggtgagcacctgtagtcccagctacttgggaggctgaggcaggagaatcacttgaacccagtaggcggaggttgcacagtgagccgagattatgccactgcactccaatctggcaacagagtgagactccatctcaaaaaaaaagaaaagttggctggcctaagaccacacagatgctaggtggcaaagccagtcttatgactccaaaaccaggcatctgtctcaccattctaaccctgctacgtcacacaaatccaggagagagaatttacataaagcactgcatgcgctttggaagaaatgctgtacttaattaagtgaaggtaacctcccagagttagccagcctttcagagttgaagtcacagcttagggattcaaaatgagctactaaaaacactaatttagttattagagaactccgggttccactttcaggatccaccttggttggccagtggaaaaacacaagtattcttcattcaacaagtactgaaggacctattattggcaatgaacgtaacatgtgttctttccttggggactgcaggtgggcagaaggacctgttcagttttactttcaaagaaaagatccacatttgaggtttaagtgtaccatattttaagaaagaaaatgtactattttctccagagtgaggggctaaggtgtgaagaacagatataaaatattaaaatgtattcagatgcccttcacacagcaaggcttgtgatgccttcatggaagtgatcaaccctatcataaacattgttagatgtggtattaaagtataaactgatgacagtacaaaaaaaaaaaaaaaaaaagggcggcc

SEQ ID NO: 4103 - DNA, 667 bp, Homo sapiens
  misc_feature (643)..(643): n equals a,t,g, or c
  misc_feature (647)..(647): n equals a,t,g, or c
  misc_feature (665)..(665): n equals a,t,g, or c
ggcggcgcgggctgcagacggctgcgaggcgctgggcacaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgktcatcaccatgkgcttctgctgcactacctggctkscctyaacattgtggccgcaactattctcttgntacnggctttttgactcggatnaa

SEQ ID NO: 4104 - DNA, 726 bp, Homo sapiens
ggcacgagccggaccctgccgccctgccactatgtcccgccgctctatgctgcttgcctgggctctccccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacacccccgcctcgtgccagcagcaggcccggaatgtgcagcactaccacatgaagacactgggctggtgcgacgtgggctacaacttcctgattggagaagacgggctcgtatacgagggccgtggctggaacttcacgggtgcccactcaggtcacttatggaaccccatgtccattggcatcagcttcatgggcaactacatggatcgggtgcccacaccccaggccatccgggcagcccagggtctactggcctgcggtgtggctcagggagccctgaggtccaactatgtgctcaaaggacaccgggatgtgcagcgtacactctctccaggcaaccagctctaccacctcatccagaattggccacactaccgctccccctgaggccctgctgatccgcaccccattcctcccctcccatggccaaaaaccccactgtctccttctccaataaagatgtagctcaaaaaaaaaaaaaaaaaaaaaaa

SEQ ID NO: 4105 - DNA, 1054 bp, Homo sapiens
  misc_feature (74)..(74): n equals a,t,g, or c
  misc_feature (1014)..(1014): n equals a,t,g, or c
aaactcatttaggtgacactatagaaggtacgcctgcaggtaccggtccggaattcccgggtcgacccacgmgnccggcgacaagatggcagcagcgtgtcggagcgtgaagggcctggtggcggtaataaccggaggagcctcgggcctgggcctggccacggcggacgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacanaaaaaaaaaaaaaaaaaaaaaaaaaaaaaaaaaaaaaaaa

SEQ ID NO: 4106 - DNA, 1065 bp, Homo sapiens
gaattcggcacgagagggtcagggaggctgcccccaggcctgtatatttaacccctatgtaccaggagtaatgaatagtaataattctatttatgtaagttatgatgacgggtcaggtagagtgagctggggagggaagtggatccatttctgctaaggaaattctagtcaaatgcatctctgtatagacaaaatgttagtggagaagatcttgttaatagaatgtctatcatcagaatctcagttgatagggtttctcttgtaatgaagtctctacaaattgggttagctacatctctgctaaacagttgatggggtatctcttgattagggggatccctaatatccccagccccagccagaagctgtgaaacctcaagtcctatggaggggagaaggactggaatgtaccccatctyccttgactgmagagcaggttcctccactgccccaccccttagacaccatgmccccatcaggttaatcccctgttgccatggttatggagacttgcagctgccatcttagatgtgctctttggggaagcccatctaacaggaggacattggtttgggggtgcacctcctgaagaatgggtggggaaggctttctctaggatcagattcaaataaatcaagtatgtattgagtgcctactctgtgcaaggcactatgctagatctggtgcctagaagccctgagaaagaacttaaagagctaggaggacagaggcccccaagctgatctggtggtgcatccacgcacccccaccctgggactttggatgctcccatctccacctccagtgacttttaaagccgcttcgtgcctttcctgtaacgttggatcctccttttctgtcccctgctgtctcaaggccccaagttaaagggttaaagccgctggagcttggggagagaacattgtggaatggaagggatcatgccctttgtggagtcttttttttttaatttaataaataaaagttggatttgaaaaaaaaaaaaaaaaaaaaaaaaaaaaaaaaaaaactcgcagggggggcccgtacccgaatcgccctatg

SEQ ID NO: 4107 - DNA, 931 bp, Homo sapiens
  misc_feature (3)..(3): n equals a,t,g, or c
  misc_feature (881)..(881): n equals a,t,g, or c
  misc_feature (906)..(906): n equals a,t,g, or c
ttnctgcaggaattcggcacgaggttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggcactgaagaacctggcacagctgaacgacatccaccagcagtacaagatccttgatgtcatgctcaaggggctctttaaggtgctggaggactcccggacagtgctcaccgctgctgatgtgctcccagatgggcccttcccccaggacgagaagctgaaggatgctttctcccacgtggtggagaacamggscttcttcggcgatgtggtgctgcgcttcccgaagattgtgcactattactttgaccacaaytccaactggaacctcctcatccgctggggtatcagtttctgcaaccagacaggcgtcttcaaccaggggccccactcgcccatcctcagcctgatggcccaggagctggggatcagtgagaaagactccaacttccagaacccatttaaaatcgaccgcacagagttcattcccagcaytgaccctttccagaaggccctgagagaagaagagaaacgccgaaagaaagaggagaagcggaaggagatccgaaaaggccccaaggwtcttccagattcccatcttgagttattaggcccttggagcagtttcarggttcagggggccacaaggaggcaagttcgggagggaagaagaggttggagttttggtttntggttggaggaggcaccattttagncccttttcccagaagggggaggcca

SEQ ID NO: 4108 - DNA, 872 bp, Homo sapiens
  misc_feature (4)..(4): n equals a,t,g, or c
  misc_feature (24)..(24): n equals a,t,g, or c
  misc_feature (32)..(32): n equals a,t,g, or c
  misc_feature (49)..(49): n equals a,t,g, or c
tgtnatagctgaagcgtgaattgncattatgntccctgcctccagaccntattttcctgcatcaacgggaaagggtcagattcactggctcagctgtttaacctgtcctggtgccagcagctggagctgggtgtcaggaccagcccgcaagctcttccctgccggaaggaccaggccagtcgctgtccttttcatgctagagagtggttgtggttgctgacttagcagagaaggtgcttggctttccccttaactggagaaaaaactttctaagaaccaggcctggttggcagcagacctagctttcttggggtggcagggaggctaaagcatacctcaggacagtcagtggtgggtccagcttcggctggaggttctttctactgaataacttctacgggctctgtcattagcaggatttgtataatttgaagcagagctgggcaactgcagagcaatggggaagccagcccagtgtggtggcaagacctgggcaacttgggaccagcctgggctgtctcttgccagctgttgttatcagaaccaggctcttcacactcagatccttgggccccccatctcagaatgcccagtggttaaaaggatgaaacctggaatttaagtgacttctcagtgatgtgtgcccttctctgacggttccttgttcatcccatgtatttactgactgcctgctatatatgcagagccaaagagtggggcctggtcttgaactatctcctcatctgccccttctggcacctccttcctcctgggctctttcctctaataccgtcatcctctctccaacctggttaatcctgtcctttctgccctcaaatgggcaccttcaaaaaaaaaaaaaaaaaactcga

SEQ ID NO: 4109 - DNA, 1543 bp, Homo sapiens
  misc_feature (47)..(47): n equals a,t,g, or c
gagctccaccgcggtggcggccgctctagaactagtggatcccccgntctgcaggaattcggcacgagggggatcagggaatgagggtctccaccccaggggtctccttgcagtgagtctatatgcaggcctgcgttctgctcctggggctggttctgagtgcccagcttcagtctcctgagaacatgaggatgggagggggcagagtcttgctgagggcacacccagttcccgctggaggaggacagtgccagtcttctgcaaagggaccttgggtgggaacgggcccggagcgggaggaacgtgactccccagagggaagatgggcatcatactgggcccagagctgggaaggagttgctgccagcacagggtgggcctggactcccctcgcccctacccccagtggttgtggctgtagcctaagcctggagagcaggaccggcccggggtgtctgggaggctgccaggtgcctccagagctcccaagggcccccacctgcaagtgccagcctcagggcagtgcccaaatgaggccctctcagctgcagccagcgatgccttgggatgctcaccgggagggaggcggctttgggctcctaagtccttgggagaggctgggagcagtcactgcgcggcttgcgcaagcccattgtcgggttgggtggcttcctcagccagggctgggagggactccaggatcaggtcctccctgtctcgagtctcagtggggtgatggggaggagacctggccacccatggctcakgggcagctgagaacaaggacctgctggagctggaagtgctgtggtgttgaggggtggggtgggcagcttctcacacctgcctcctgcctccttctgtccacctttccascascctgacctgtcccagccccacacatggttctgcctggctggcctgcccttggcacctggcgtagagcacacagaaggcactcagctaatgctgggcaggcccactcatggggagtgcgtggctgtgcagcaccagggaaccggcacagcagcgccggcagaaatcacagcagtaaacttgtccgggttgtatgcatcaaggtkgcgatkgacgtgggtccccccactgcactgtggccctgagcactgtatagcagcccggcaatkggagccattatcttgcccctttgacagaggaggacacagaggcacagggaggtgaagtagctgccccacactagtgcctmctcgctcactcaccacccsctgcaccacagtgcagccgcttctcccaccagctkgggttccttggacccccaagcctgggaagggggaggtragtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggccagtktcccacttcggggatctctctcgcagaaccgagggtccccttcatgggggttagatgcccagggctagctgtt

SEQ ID NO: 4110 - DNA, 810 bp, Homo sapiens
  misc_feature (21)..(21): n equals a,t,g, or c
  misc_feature (30)..(30): n equals a,t,g, or c
  misc_feature (44)..(44): n equals a,t,g, or c
  misc_feature (58)..(58): n equals a,t,g, or c
  misc_feature (102)..(102): n equals a,t,g, or c
  misc_feature (130)..(130): n equals a,t,g, or c
agttcggaagctaccaggaangtgaccctnggggtttgggaacnttggggaccattgncccaggtcaagcattggggaacaccccgggttccaagcaggagntctggtctgtcctggggtctttgggggncagggctgcggccttgggcaaggcttcctccaggcggaggtcstggggaagtgggggaasccaggccagtgccgcmtcccccactatgtmgcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgcaaaaaaaaaaaaaaaaaactcga

SEQ ID NO: 4111 - DNA, 1409 bp, Homo sapiens
ggcacgaggaacctcccgcgggctttggactgaggtccctgtggcgtcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcagggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctgtctcgggactcctgaccgtggtgtgcgtgtgtgcccgtctgtgactttctactcaccaagggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaaaaaaaaaaaaaaaaaaa

SEQ ID NO: 4112 - DNA, 1542 bp, Homo sapiens
  misc_feature (1445)..(1445): n equals a,t,g, or c
  misc_feature (1515)..(1515): n equals a,t,g, or c
  misc_feature (1520)..(1520): n equals a,t,g, or c
  misc_feature (1535)..(1535): n equals a,t,g, or c
ggcasagccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtcttaaccctgctcagcagactctctactttggggagaagagagcccttcgagataatcgaattcagctggttamctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttccttggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccagggccctgtggggacttgctggggccgtcaccaacccggacttgtacagagcaaccgcaggggccgsccctcccgnttgttccccagcccacccacccccttgttacagaatgtytkgtttggggtgcggttttgtwattggtttnggatnggggaagggaggganggcgggg

SEQ ID NO: 4113 - DNA, 3260 bp, Homo sapiens
ccacgcgtccggcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctggggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgaaggcttccctgggagcggccggccaccgcccgaacaagcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtccaggagacaagcttctttgatgagaaccgcacaggggacctcatctcccgctgactcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggcatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccctaaaaaaaaaaaaaaaaaaaaaaaaaaaa

SEQ ID NO: 4114 - DNA, 3230 bp, Homo sapiens
  misc_feature (11)..(11): n equals a,t,g, or c
  misc_feature (13)..(13): n equals a,t,g, or c
  misc_feature (16)..(16): n equals a,t,g, or c
gacgcggtttngnttnattcccggttatacatcctaagagcaacacccattccagggcagtaggaaaggaaagcagccagggctgtctcttcaaagaggccaaatatcaagatcttgttcttcatcccctgctggaagaccgaattcctcctggtcttacagatgaccaagtcggcccactgcaccaccacgatactgacgaagaaggctgtgtggcaggtgaactccacgattttcctctgctcataggtccactgctgcccgtagctgtcttccacatcgttgatccagcggtcatcccagtccactcggaggcccaacaggtgaattgggaggaagccgttctcagccagaatcacaaagtaagtaaagaagcctcccagggcctggatcattccaatctgcccataggccatgctgatcagccgctcattcacaagtttgtctgttttgggatttctgggctgtctcttcatgatgtcactctcagcctgctcataagccagggagatggcaggaaccatgtcagtgcccaagtcaatgcagaggatggtgacagtccccagtggtagtggaatgtttgcaataataaatatcaggaacggggtgatctcgggaatgttactggttaaggtataagcaatggatttcttcaagttatcaaagatcagacgaccttcctctactccagtcacaattgaggcaaagttgtcatccagaagaatcatgtcagcagcttgcttggacacatctgagccagcaatccccatagcaaccccaatgtctgctttcttcaaagctggagagtcattcacaccgtcaccagtcacagccacgatagcaccctgtctttggcagccttccacaatgatgagcttctgctgaggggaggtcctggcaaacactatctcagtgtggtacttcaaaatgtcatccagctgctcggaggtcatgtcctttagatcactgccgtgtactacgcaggccttggcatccctggggttcacctggctgactgggatgttgaggcgggcagcaatgtcttccacggtctcattgccttctgagatgatgcccacacctttggcaatagctttagctgtgattggatggtctcctgtgaccatgatgaccttaattccagcacttcgacatttgcccacggcatcaggaacggccgcccgtggagggtcaatcatggagatgagcccaacaaagcacagattatcgatagggaaattcacatcgtcagtgtcaaactggaacccttcaggaaactgttcatctggcagaaagaggtggcagaaacctaggactcgttctccgaggccccccagctccaaataggcgttctgaaaggcgtctttcagctcctcatccaggggctgctccttgccgtggaggaggatagagctgcaacggtctaggatcctttctggggcgcccttcatcaccaacaggtgttggggctccgatgtgttggggttcttatgaatagacaactggtacttgttggtggagttgaagggtatctcgacgattttggcgtatctttctctcatctccttcacggaaccacagcacagctctatgcactttaagagtgctgactcagaggcatctcctgcaactgcccgcttaagaataggtaggttttcctggttagcctgaaacactgccctgttacaaagacctgcaattctggacagagcaagccaggtagctgaagtcttgtcaaaagagacaccactctgattctctgtcgtatcagcttcatggatttgattgtcaaaccacatgtgggccactgtcatccggttctgagtcagagttccagttttatcagagcagatggtggacgtggaccccaaggtctccacagcttctaagttcttcactaagcagtttttccttgccatgcgtttggcagtaagtgtcagacagaccgtgacagtggccagcaaaccttccggcacattggctacgatgataccgatgaggaagatgacagcctcaagccaggtgtactcaaggatgagagaaaggatgaagaaagacacacccaggaacacagccacacccgtgatgatgtggataaaatgttcaatttctgcagcaatgggggtctggcctccttccagcccagaagcaagtgtggcaattcttcccatcacagtgcgatccccagtgtagacaacaataccacgtgcggtgccttcaacacaattggttgaaaagaaggcaatgttcctcgtctccagggggttttcatttgtgaaatctggagacctagtctggggttctgattcaccagtgagcgaggagttatccaccttgcagccatttgcagatatgattctgaggtcagcaggaattcggtctcctccttttacttccaccagatccccaaccacaacttcctccgcatttatgctcattttctcaccatttcgaatcacaagggcttgctgagggaccatgtttttgaaggattccatgatctttgaacttttagcttcttgatagtaggagaagcaaccagttatgattacaacggctgatagcaccacacccaggtacagattatcgttttgaggttcctcttctgtagcagcttggatgctataagccaagaaacaaagaatcgctccaatccacagtaacattgagaaccccccaaagagctgccgacaaaacttgatccattcaggagtagtgggagggggagtgagggcgttgggaccatctcgcgccaggatctcagctgcacgagcagatgttaatccccggctcaagtctgttccatatttacgatgaagttcatcaaggctaagtttatgatcatccatagaaacttctttcttcagttcatccatgtccctgtcttttttgccctttttgccctttttatcaccttgttctgaaacagctgcaggctcatacttatcacgtccaacccccttccccatggtggcggtgctcagtgccggcgccgggtcctgtcgctggagaatcagagagaaaagcacagagcagctcccggccgagcgagcgggaccaggggagccaagtggagggagctagggctgccgcggggcgggagggtgggagggcggccggcgctcgggccgatgccgccgccgctgttgtgccgccgcccgggctgtaccgctgttgccacgtgtccgcctcctcccgccgctgctctgcgccccagaccccgccgcagc

SEQ ID NO: 4115 - DNA, 1036 bp, Homo sapiens
  misc_feature (1012)..(1012): n equals a,t,g, or c
  misc_feature (1024)..(1025): n equals a,t,g, or c
gtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaaaaaaaaaaaaaaaaaactcganggggggcccganncccgttccccg

SEQ ID NO: 4116 - DNA, 390 bp, Homo sapiens
aggtctcccagaacatcaatgtcttcctgcggaacacagtcaaggtcacgggcgtggtggtcttcatgttcagcctctcatggcagctctccttggtcaccttcatgggcttccccatcatsatgwtggtgtccaayatctacggcaagtmctacaagaggctctccaaagaggtccagaatgccctggccagagcgagcaacacggcggaggagaccatcagtgccatgaagactgtccggagcttcgccaatgaggaggaggaggcagaggtgtacctgcggaagytgcagcaggtgtacaagctgaacaggaaggaggcagytgcctacatgtaytacgtytggggcagcgggctcacactgctggtggtccaggtcagcatcctct

SEQ ID NO: 4117 - DNA, 868 bp, Homo sapiens
ggcacgagatcactagcaatcaaatgcttgtgccagtgatagaaaaattaagggaaacaactatttcaaaagtcagccaagtccgggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaattaaaaaaaaaaaaaaaaaa

SEQ ID NO: 4118 - DNA, 2150 bp, Homo sapiens
  misc_feature (1020)..(1020): n equals a,t,g, or c
  misc_feature (1022)..(1022): n equals a,t,g, or c
  misc_feature (1029)..(1029): n equals a,t,g, or c
  misc_feature (1177)..(1177): n equals a,t,g, or c
  misc_feature (1430)..(1430): n equals a,t,g, or c
  misc_feature (1500)..(1500): n equals a,t,g, or c
  misc_feature (1967)..(1967): n equals a,t,g, or c
ccacgcgtccgggcggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttatatttcttcttttccttttggtttcataatataccgcagtttgttcagncngatcagnacaaagcctgatagtactttactaaaatgactgcattctttggattccttcagtctatggttcaagtcactaaagattcatttttgttgagtccccatgagaaacagcagtatgaatcttgacggtttctgcccgtcctaatggcagncctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtgggctttttttctttncacattggcacattcacttcttccactcttggcatgtaagaaataagcatttacataattgggaaaaatntggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtctttcttttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgcttttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcnccttaggacaactgttgcatgccaagttttttgtgtgtgtgaaacacttcaaaactgatttaaaagatgtaaatttaaaattggttgtatctaatatgccccaggttcggtaaataaacaattctttttaaaaaaaaaaaaaaaaaaaaaaaaaaaaaaaaaaaaaaaaaaaaaaaaaaaaaa

SEQ ID NO: 4119 - DNA, 808 bp, Homo sapiens
cggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcccaacttatgtttctttgagattaatagatattgggggaaaaaa

SEQ ID NO: 4120 - DNA, 1170 bp, Homo sapiens
gctcctgggcctcacaaagtgttgggattacaggtatgagccacggcacctggcctggtctcttaactggttccctaagacagctggaaatagagaatgtcatggagcattcctaaccatgggctccagcctggctttcattctgtttctcccctgaaacaacattcctttagtaatattccgaataacagcttcatcagtctgtctaccgaccactcttcaggcttcatcttatatgacctcccaaactgcactaagggttgtattagagaaaagtggataaagttcggagtcaggctgcttgagcttaaatgccagcttcacttaccagccacctgaccatgagtcagctgcttaaccattctttgccacagtttccttgtctatgaaaagggaaatggctcccacctcaaaaagttgttaacattaaattcaatcatgtattcaaagtcctgagcagaatgtctggccatgactgggacttaacagatgttagcatttattattagtatctgtcagtcttgaaatgttctcttcccttggctttcatgacattccacactctcctggttttctcttacctctctggtaatacctgtttgcttatccttctttgtccagctctgggatgttaccattccttcaggcgtgctgttttctccttaggcagtcttacacacactcatgacttccttccattgtcctccacacactgatgaccctaaaatcagtatctccagcctaaacctttccactgagttctagacccatatgttgtactatcaacctggcttgtccatttgaatgtcttccaggcacttcagactctcttctctagactttgctggactttcactcttccccctaaaactggctcctcttccactgaaacatgtatgtcattgagaggcaccaccatccacccagtgcctaagccagaaacctaggaatccttgatacctgttctctctcatcctgcatatccaagcctatcagttttatctctaaattatattttggtaggtttacttctttccttttctcccaccaccaccctgctccaagctaccatcatctcacccagaggttgcagtgagcccagatcacgccactgcactccagcctggtgacagagtaagactccatctcaaaaaaaaaaaaaaaaaaaaa

SEQ ID NO: 4121 - DNA, 523 bp, Homo sapiens
  misc_feature (502)..(502): n equals a,t,g, or c
gaattcggcacgaggcrgsgcggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggaggtgcgggctagctgcccgcagctgaggcttggtcgcgtggccactcggggattggtggcacctgggaccggcgcggggcctgtgtggggagtgggcttggaagtcgctgtccgagtcctggagaagcccaggccgccaccccccgccccgccccggccacggcgacctcctaacggccccttttcccgcgacttgcctgggttccgggatcccttgggggctccttcggcangcttggttgctttgggttttc

SEQ ID NO: 4122 - DNA, 1189 bp, Homo sapiens
ggcacgagtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagaggacggacagcagcgagccctgcggcctctcagacctctgcaggagcctcatgaccaagcccggctgctcaggctactgcctgtcccaccaactgctcttcttcctctgggccagaatgaggggatgcacacagggaccactccaacagagccaggactatatcaccttttgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagaatactggaaatggtgcccgtaacatactaagtgccaagtaaacgttacctgctgcctcaagtgatgacgtcccattaagtgggggctcctccggaagctgccagaagaggccgctgccttgtcatcggttctctggttcccagcttacagctcttccctcgagctctgactcagtgtgactatatctgaatgtgttccctggagctctgacactaatttagcaataaaaccttctgggacattaaaaaaaaaaaaaaaaaaaaaaaaa

SEQ ID NO: 4123 - DNA, 1779 bp, Homo sapiens
aggaatacatacgatccttgtctaccaggagtctaatagaaagatggacagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggatygctgggccctaggctcttgcttctggggctattggagggtcagtgtctgtgactgaataaagttccattttgtggtaaaaaaaaaaaaaaaaaaaaaaaaaaaaaaaaaaaaaaaaaaaaaaaaaaaagggcggcc

SEQ ID NO: 4124 - DNA, 608 bp, Homo sapiens
  misc_feature (11)..(11): n equals a,t,g, or c
  misc_feature (573)..(573): n equals a,t,g, or c
  misc_feature (577)..(577): n equals a,t,g, or c
  misc_feature (585)..(585): n equals a,t,g, or c
  misc_feature (589)..(589): n equals a,t,g, or c
  misc_feature (596)..(596): n equals a,t,g, or c
tttaaacgganatactcggaacaaaatttggagctccacccgcggtggcggccgctctagaactagtggatcccccggtctgcaggaattcggcacgaggcagcgtgaggcgaggtcaccagccgctccctgtgggtgcggcagaagagactgcacgctggggagtggggacagcctgatggggcagggggcctgcaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgagggattccctacccacccaccccctctgaacctgtnccanagcaccanctgntaccttnttccctgcctta

SEQ ID NO: 4125 - DNA, 2055 bp, Homo sapiens
  misc_feature (175)..(175): n equals a,t,g, or c
  misc_feature (497)..(497): n equals a,t,g, or c
  misc_feature (1352)..(1352): n equals a,t,g, or c
  misc_feature (2041)..(2041): n equals a,t,g, or c
  misc_feature (2045)..(2045): n equals a,t,g, or c
  misc_feature (2051)..(2051): n equals a,t,g, or c
agcaactctatagatcatagaggaaacggtacctgcagtaccggtccggaattcccgggtcgacccacgcgtccggcactgcatgggaatagcggccctggaggatgttagacttgctccctctccaagacagcagcagcctgcacctgccccgtgtgtgtggccggcctcytcntcacccttcccggcccccggccaaggacccaggcgctgcatacaggggaggggcgcacccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtgnatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgnccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaaaaaaaaaaaaaaaaaaaaactcgagggggggcccggtaccnaatncgcccnaaag

SEQ ID NO: 4126 - DNA, 655 bp, Homo sapiens
  misc_feature (25)..(25): n equals a,t,g, or c
  misc_feature (52)..(52): n equals a,t,g, or c
  misc_feature (60)..(60): n equals a,t,g, or c
  misc_feature (536)..(536): n equals a,t,g, or c
ctccaggcggagtcctggggaagtnggggagccaggccagctgccgcctccnccactatngtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccanggccatgcccctgctgctaatgcttgccctaacccttaccctaaccagcgtccagcgtcgtctcaccgagccgtaaataaatcaacagattcgcaaaaaaaaaaaaaaaaaaaaaaaac

SEQ ID NO: 4127 - DNA, 452 bp, Homo sapiens
  misc_feature (12)..(12): n equals a,t,g, or c
  misc_feature (25)..(25): n equals a,t,g, or c
  misc_feature (93)..(93): n equals a,t,g, or c
  misc_feature (132)..(132): n equals a,t,g, or c
ctgagaaatggntttgatcaatatnttgagggaagtaaactgtggtacatgaagtcactgactaatcatgagaaataaaccgacttagcaatnatggtaaaagcagatgtcaaatatacattttgttcaggnttaaggattgtcctgaattagataagataagctaaaagtttaaacaagttataaaaagtttctataaaattcatcttgccaaagaaattttgtccatgaacattaaattacgaaaggtattatatgtttttttggtaaattaagcatttaaataatagcacaacaaggtactcttaaggcactaatctgctctttagcaaaatttgtaaagtgttataaacgggttttacttttgtaaattttttgaaacaattgtggcaaaataaataacatggtaatctggaattctatttcataaaaaaaaaaaaaaaaaactcgag

SEQ ID NO: 4128 - DNA, 1105 bp, Homo sapiens
gaattcggcacgagaacaaattgaaaccatctggtcatgaacttttatttgttaagaggttttctaatattgattcaatctctttgcttattctaaatgtgttcagattttccacttcttgagtcaatttggtaatttatttgtttctaggaatttgtccatttcatctagtttacctaatttttgacatataaaattatatatggaaatttctaaaatatttaaaaatttctgtaatgtcaatagtaatgtcccctcttttgttaccaatttgttatttgaatcttctccttttttttgtcaatctagctaaaaatttgtcaattttgttcgtctcttcaaaaaaatatacgtttgtcttcatgatttctctawtgtttttccatcyatatttcatttgaatacatttttaaacyttayctttattatttcattccttctgggagctttgggtctcatttttttttcctgataatctagttgtttattgtataagattaagtatttatttgaaatctgtatgttctttaatgtaggcattcactactataaatttacttctcaggagcatctctgccgcattccatgttttagtatgttgtgttttaatttgtattcataactagagggaaacagaggtgacggagaaaaagacgtacaaatatcatccacttgcaaagtatagatttgtttgtattgkratatgaatraaaatattacgagacagataagaaaatttgaacactgaccattgatgcagttacagttaattttaaaatcaaggttaataacattttagttattttaaagaatgatagtaatttagagatgtattctgaatgtttttaaatgaaaagatatgcctgggatttcttccaaaatgaatcttgtaggttgggaagaaaatgagaacatagtggaaacaagactgacaatgagttgttgaggttgggcaatgcgtacactaaagcttattttatcttattttactgtatatactgttaaagcttgcattattttcataaatgcatttgctaagtgcaactgttatcaaataaagtggattgggctctaaaaaaaaaaaaaaaaaaaactcgaggggggg

SEQ ID NO: 4129 - DNA, 1212 bp, Homo sapiens
  misc_feature (22)..(22): n equals a,t,g, or c
  misc_feature (1184)..(1184): n equals a,t,g, or c
acggggggatgtaaagggaaanacttcctcactaaattgaacaaaagctgccagctccaccgcggtggcggccgctctagaactagtggatcccccgggctgcaggaattcggcacgagctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgmcccctccccgagacctgtcctgccgtccgcgggtgtgtggcctgtaggggactgagagctgggcttgctgggcacctctggaatctgaccctgtgggccggaaaaaaaaaaaaaaaaaaaaaaaaaaaaaaaaaaaaacnaaaaaaaaaaaaaaaaaaaaaaaaaaaa

SEQ ID NO: 4130 - DNA, 1130 bp, Homo sapiens
ggcacgagctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4131 - DNA, 1326 bp, Homo sapiens
ctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtcaaaaaagaaaaa

SEQ ID NO: 4132 - DNA, 1391 bp, Homo sapiens
  misc_feature (1350)..(1350): n equals a,t,g, or c
gcagaggccgactgctgaaggtggtttgcgtcgacatggcggttaccctgagtctcttgctgggcgggcgcgtttgcgcgccgtcactcgctgtgggttcgcgacccggggggtggcgggcccaggccctattggccgggagccggaccccgattccgactgggagccggaggaacgggagctgcaggaggtggagagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcaaaaaaaaaaaaaaaaaaacncggggggggcccgtcccattgcccaaaagggggccgaataa

SEQ ID NO: 4133 - DNA, 2142 bp, Homo sapiens
  misc_feature (891)..(891): n equals a,t,g, or c
ctccaccgcggtggcggccgctctagaactagtggatcccccgggctgcaggaattcggcacgagccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagnctcagctactagggaggctgaggcaagaggcttgagaccaggagctcgaggctgtaatgtgccatgatgattgcacctgccaatagccactgcactccagcctggccaatatagcatagaccccatcctttaaaaaattttacaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgccagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattcaaaaaaaaaaaaaaaaaa

SEQ ID NO: 4134 - DNA, 1357 bp, Homo sapiens
ggtttagaggacgtatatttaaataaacttatacagctaaagaaactgactttcacttcctcagtgacttaatttcactacatgctgatttgtcctttgcagtatttagctcagaccaagacagaattgtatgtgctattagatttgcaaattgctgatctcccagtgactttccctcttagatcccagttgagtatggttaccttgagaactgtggtattagccatgttagagcatgctccactggggagttctgtgcagtctatttttaatgctatttaatgaaggagcgagcgcctcactcagcaataaaagaagcatgagggaagacagagcagtgcatggttatggatactggacaaggatatttggaaaggtaaaggctgaccattggatatggtaattttaatgaagtcctaatatatcatatgaatggaaatatggatttttgttagagaattatacatgaatagttcaataggtgttttcgtaaacctcttcactagttcttagaaagaagactcaataatttgagtttttaaaacttgagggacatactaaccagggagttcctgcatgcagactatttttaatacaagctgtcatattcttgggtggtgagaagtacagaaataatttcaaattcctaaaatattgttcggtgaaaggtttggagcttgtaaaacgttctgcgaataaaataactaatatgcttctaagatactacaataacctgaagctctgccttgtgaattgcttcattttcttttatgaacttggagtctaggtccagaattgtcacaactaagagaagcaggaagttttgtttggacttgatagaatatttggggtgttttctctccttagaattaagataagccctacagattatcttactgaagtctaaatattttaaaaatataagtagcagaggcagcactggtaacttttgtaatgtcacaataaagggcaaaatatcttaacattatagtgtgtacaatgcaagaagccatctgtctgcaacatttgtatatatgcagaacacctgtcttgaggtagaaagtgagaatgttcaatcagaaaggtcttgtgttgattttcatattaacaacatactataatcaggttattcttttgttcagagtaaagctaattagacaaaatgcttaagtagttgcaaggttaataaacataagagaaagtaagcagtttctattaaatggggaagttagtcatataatttttaaatgaagctgttagaacaatgtgcaaagttgatctggatttttgccaattcctatgaaaaataatccccagaaataaactactaaggaaaataaaaaaaaaaaaaaaaaaa

SEQ ID NO: 4135 - DNA, 1907 bp, Homo sapiens
agttcaggggcacaggggcacaggcccacgactgcagcgggatggaccagtactgcatcctgggccgcatcggggagggcgcccamggcatcgtcttcaaggccaagcacgtggagactggcgagatagttgccctcaagaaggtggccctaaggcggttggaagacggcttccctaaccaggccctgcgggagattaaggctctgcaggaratggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgarggttggtctcgaggcagaggtcatgttcccagccaagagtatgagaacatccagtcgagcagaggagattcatggcctgtgctcggtgagccttaccttctgtgtgctactgacgtacccatcaggacagtgagytctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtgcttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttatggtatcagataccaatatttaaaagtttgtataataataaagagtatgattgtggttcaa

SEQ ID NO: 4136 - DNA, 2350 bp, Homo sapiens
gaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgaggtgctgccatgcttactgagtcccttctctctccttctctatcatcttccatcagtgagtatcaccagccttttgcgacataatgaacctacctcaaagtgcagctacaccagcactctccaatcctcacctcactgctgtgctccagaacaagtttggcctgtcactgstcctcatcctcctgagccgtggtgaagacctacagagttcagaccctgctacagaatcaacacaaaataatcagtggacggaggtgatgttcatggcaacacgagaacttctgcggattccccaagcagccctggccaagccaatctctatacctacaaacctagtgtccctcttttctcgctatgttgaccggcagaaactgaacttgctggagasaaaactgcagctagttcaggggatacgataaaagatctccaaatgtgtcctgtacctccttttggctgccacctgcactgctgccatcaccaatggrgtgtttttaatgagggaaggaaggtagctttttccccaaagcaaagkmttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcatttwctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccargggcctgggttttgaataattgcaagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaaaaaa

SEQ ID NO: 4137 - DNA, 1678 bp, Homo sapiens
aattcggcacgagccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgctattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgttatgtggattaaatagttttaaaatacatatttgaagmcctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggkttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctccctgtgactttaaaaaaaaaaaaaaaaaaaaaaaactcgag

SEQ ID NO: 4138 - DNA, 1837 bp, Homo sapiens
aggaagaaatgaataatgtgagcattaggggcggcagtgggattactcagtgttgagagaaacaacacggaaagcccagagcagaggagggagaaggccccattctctcagctttaatctactgcacctcggagggcagagctctaaccagacaccctggataagagtccgctggctcctggaagctccctggtagacccccagatctctctttgggtgctgatggccattctgctggcctgcttcacagccgtcttggccttcatctgcctccagttctggtgtgtccgttgccatgagccgcgatggtcttacagggctggccacatggaggaggccaatgggttggtgagatggccagaggaggccccggatcttggtcagagggaggaagacctgcaggggctccccctggtggaaatgccacgcaagaactccagagatggagctgaactggatcccgaagccaaccaggatgcccctgatgcgggtgccttacagagggggggtggtgacccacccgctatactgcctcattgtggggaatgagagtggggaggagagcgcccgcatcatgtagcctaaagctttccacacagtaggtcgtttgtacaaatgtgtctatagactacccatttctctcccatcaaacgtcactgctattgtaggtcacctgggttggatgaatgccccatgacaaagcttctcaagctggaaaatgtatcccccagggtatgccaaggcacaaacraggcatctcagcagcagcrtccactcggaggacacagttaagaattgaaagcattgttttaacattaaaacaaacatggatatgttataaagtagaaagcaaaaatttgcatgacttaaataaaacacagcacttgaaggaaacacttgagtwacaagtaggctctcagargtacacttttgggcaaaggtagatgtccagtttcctctgcccttgaggggattatttggaaataatttgggattatttggaaataatttgtgagaacccttgctctggagtgttttccaacttttaggcaatcacataccaccgytytctattttttaaaaccatggattatcttcactattattaataatactttcctttaaattgaytcattttttaagcgtaaacttattttcaaagacagccttatattactccataagtgaaaaaccagcaccctcytgctgcaaacagaagggaagagacataagaataaacatcatgaaaacaagataatattaaataatctgacttagcttctattgcctgccagtgattctgagcttaatgcctgcttgcttgtctttgataaaaagggagatccagtgttggagaggtaataaagacatattagcaccaatatttgtctttctccttgatatagcataagatttgaaagagaatcgaaaagggaagtgctgtttttactttgcgagtcagtgttagttaaatgccatgtctgtgaaccacctcaaatgctgtcagtcagcttcccttgatttgagaaaattgtcttgaccagactaggcaggctgttctggagaagacgcctgtactctccaagcatcatccaagaccttcccagtaccctcttatatctatagagcacaaaatcccagaatcacaggacgacactgcagtgaatcaactaagaaacagcaggagctgagaagccaagacgagaagccccacatccctattcccttgcctacctcatgcattccctgctcggcacccagacttttgcccccattcctgctacttgtgaacaaataaagattcatatactcacaaaaaaaaaaaaaaaaaactcga

SEQ ID NO: 4139 - DNA, 2197 bp, Homo sapiens
ggtttgagaaactgtagtacctagctttctccaaggctgtttgatgctgggatcctcttgtggggggcgtctgtcaacgtcaccatttgggaagtgcgcaragctcaragcagcgcttccatgcttccttctgcttgggggcccctccaggtagcttctttcttcttgctatcttttyctttctgttttctctcctcttccccgcaccttgggaggcaggagacccacttkgtkgtgctkgargatgatgagggcgccccgtgcccagcagaggatgagctggccctgcaggacaacgggttcctgagcaagaatgaggtgctgcgcacaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagccctgaagcccagagggagactgtgtttgtgtgtgcctcgtgtaaccagaccttgagcaagtgagaagagaggccagggtccaaccaggcacccgtccttggggccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcagcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttmaaaaaaaaaaaaaaaaaactcgtag

SEQ ID NO: 4140 - DNA, 1181 bp, Homo sapiens
  misc_feature (1030)..(1030): n equals a,t,g, or c
  misc_feature (1137)..(1137): n equals a,t,g, or c
  misc_feature (1170)..(1170): n equals a,t,g, or c
agcagagatgtcaggtagggtggaagtaggtgacaactggggccagcttctgagctataaaactgtacaaacatgaagaatagttttttcacagtgagctgggctcttacttgctccttctcttgggccacagtgtaaatgagaacacgtagtctctcttccttccacataatgccctcctggggaatgttatcccgccacaccttcaggtttaatccttgaacaagcacctcctaaacctcatctttgtctctaaatgtgctactgagccctggcagcctcttgtcacacccatgggcttcttatcctctgtgtcccgtgctgacctcggcatctttctgccatttttcctcttcccatttttttctcccatatcagtgacagcccattgggccttatcctgaatgcctctctcgcctctcccctgcttcctctgtgctagtcaggcaccagtgctttacattctgccgcctggttatatctgtgtgtcttctctctaccctcacagcgttcatcccaggtatagactgaatatccgaagtgctccaaaattccaaatgttttgagcaccaacgtgacatttaagggaaatgtttattggagccttgcaaatggatttggggtgctcaaccagtaaatatgcaaatattccmaagttcaaaaaaatcccaaattcagaacacttctggtcccaggcatctgagataagagatactcagcctgtatcatctcccccttcctagcctcctggaagtccacagcctctsctcctgtagtttttcccttgaaacttcttttcgaagcactttcacttcgtctttttgtttgttcttcaccgtaagccagtgaagtgagcagggtttaagtaagtgtcctcagtatattggtgaaggaacagacacagttaggggtcaagactctcatgaggttactcaaggaaccagagaaagaacgggactcagactcagatttctcccctcttcagcagactgagggtaagttggggaggcatgaagaggtcaaggcttgngatcagcctgccagctttgccagagcaggagggggctgaggcagaggtgatcaggatagcaagtgccaccagcagctctcacatagtgagcacctgccatgtgtcangtgccatgctagacacttgatgagttctctctnctttatcctca

SEQ ID NO: 4141 - DNA, 1089 bp, Homo sapiens
  misc_feature (7)..(7): n equals a,t,g, or c
  misc_feature (19)..(19): n equals a,t,g, or c
  misc_feature (38)..(38): n equals a,t,g, or c
  misc_feature (43)..(43): n equals a,t,g, or c
  misc_feature (154)..(154): n equals a,t,g, or c
gtcaaancaagccaccacntccagcagcccctgctgcnccgcntgctccagcccctctggagaagcccattcgttctcatgaagccacgggaggaggggaargggcctgtggcgtgacaggtgcctctacccctgagggcaccgccccaccacnccctgcagcccctgcgccacccaagggggagaaggaggggcagagacccacacagcctgtgtaccagatccagaaccggggcatgggcactgccgcaccagcagccatggaccgtgagttggggctgggcagtaccaggttgggaactggcgtctcctcacagatcctcactgcatcctctgtctcctgctttctccaatctccagctgtcgtgggtcaggccaaactactgcccccagagcgcatgaagcacagcatcaagttggtggatgaccagatgaattggtgtgacagtgccatcgaggtaccgaggggtcctgccctgcctgagcttccgcacatcctgcatcctctgatcttccacctctctgtaggcaacaccagactggagggttttgaggcaacttacagcagtgagagggggtggtatcagaacattctcacctaaccagagcggaatttcaactagmwcggctgtgcttgctagttggtaaaatacagaactcctttggtaccgattggtaaagaagtactctmacwamcaccccaggacccctgggatctcccgtgccatccacagcaggggagtcttttggaccctgctccagtacccttcttatttggttgaaacccttgctggtggctcatgcctgtaatcccagcactttgggaggccaaggtgggagaatcgcctgggcccgggagttcaagaccagcctgggcaacatgggaatactccgtttctaccaaaaatttaaaaattagccaggcatggtggcaggaggcatccaggccactcgggaggctgaggtaggaggatcacttgactccgggaggtcaaggctgcggagagctgtgatcatgacattgcactccaacctcaacaacagagtgagaccctgtctcagtaaaaaaaaaaaaaaaaaaaactcgag

SEQ ID NO: 4142 - DNA, 534 bp, Homo sapiens
  misc_feature (512)..(512): n equals a,t,g, or c
  misc_feature (517)..(517): n equals a,t,g, or c
ggtggggagccacgcccctcatcctgcagcgagtccctgcacatctccaactggaccgtgtcctatgcccctgaccctcagaacatctactgggagcacctctccatccgaggcttcatctggtggctgcgmtgcctggtcatcaatgtcgtcctcttcatcctcctcttcttcctcaccactccagccatcatcatcaccaccatggacaagttcaacgtcaccaagcctgtggagtacctcaacgtgaggcctcatgcccctgtcactttccacgctgggtcacaacacacagataccaggccctgatccctcttccacttgcccagcccagcccgttctgcttgttccaaccccgtgccaccaaccagctcccaaaaacccctgtgtgcacttcccttgggctccctgccaacttccccctgagagagggcaacctcaggtgtgcaaaactggagaaacacccagggaagagagagagctgcatttagtctgatctagagaagtccctntcctnaaccctcagttaatgaa

SEQ ID NO: 4143 - DNA, 1770 bp, Homo sapiens
  misc_feature (78)..(78): n equals a,t,g, or c
ttcccaggggacactccttggacattgtccttgttgggggagcaagtctggggcctgggctcacttgacctgtaccgntccctgctcccctccctccagctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccgggcctgctcatgtacatgatccggctctgcctggcgcgctcggccgccgagaggcgcaacgtgaagcggcatcaggcctacgagttccggtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatkgggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgtttttttttkggtttttttgttcttttttgtttttttcctttaaaataaaaacaaagaaaagctctgaaaaaaaaaaaaaaaaactcgagggggggcccggtacccaattttccaaatagtgat

SEQ ID NO: 4144 - DNA, 958 bp, Homo sapiens
  misc_feature (3)..(3): n equals a,t,g, or c
  misc_feature (34)..(35): n equals a,t,g, or c
  misc_feature (906)..(906): n equals a,t,g, or c
cangcttgtgggactgccccagggcccaggagcnngaaggcaaagtgttgcccagagaggatgggtcattgagggcaggccacagcgaggcgtggtgtgagtggaggcaccttaccgtktccartgggcttcaaaraaggctgagtaktagacratgktgggaaggarggccgagaagcaccacagcagcaggktggggaagaactgggtratgatggggttctgcagcagggcacaggggggcgtcaggcagggcagtmtagggggcccaggtggctttgcttatgtgcctcctccccagctgggcccttggcctcacaactctcagggctcccatgttggaagcccagaacatccggagggctggggtgagggtgggggccagggccatatgtataaccccagggtggataatactgatagtcagcatttgctgaacawctactatgttctaagcagtgctgatgtacttgccatgtcttaatcctcacaataatgctgttaccccatttgacagatgagtaaactgaggcaaaaaaaagattcaatagcttccctagctagcaagccatgaggtagggatttgaatccatgcagtctggtcttatctatwatggtwttatcactccaagtgatttgcaaactgtccttcttcaaactctgaggttctaaagaggtatgctctawgcgtgggaggagaggtgaggggaggccaggcagacatgcatgccaccctactgtcatcggagcagccctgcttttccacactgggtttcacaccgataaagagatcagaatccaagtccaaagccactgatctagtcaaacctttccattttttcagttagactgaggggtgagggaaggggacttctctgagatcaggactaaatgcaggctctctcnctttccctgggtgtttctccaggtgttgcacacctgaggtggcctctgctcc

SEQ ID NO: 4145 - DNA, 1774 bp, Homo sapiens
ggcacgaggtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggaaacggtttttggcccaagggaacattaatgacttacccttttgggactctgcctggtcttgctgagcccccggttagtgcattgcggcccgagggctccgagccaccaggttccccacttcgggcccttcgccggaggccaggctgttcacgcaagaaccgcacccgcagccatgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaaaaaaaaaaaaaaaaaa

SEQ ID NO: 4146 - DNA, 1777 bp, Homo sapiens
ggcacgaggtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacggtgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcaatacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggaccgcgtgccggccggggacaggcccggcgggaaacggtttttggcccaagggaacattaatgacttacccttttgggactctgcctggttttggtgagcccccggttacttgcagtgcggcccgagggatccgagccaccaggttccccacttcgggcccttcgccggaggccaggctgttcacgcaagaaccgcacccgcagccatgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaaaaaaaaaaaaaaaaaa

SEQ ID NO: 4147 - DNA, 1237 bp, Homo sapiens
  misc_feature (556)..(556): n equals a,t,g, or c
  misc_feature (619)..(619): n equals a,t,g, or c
  misc_feature (672)..(672): n equals a,t,g, or c
tgacgtctggggggcgcctcaaatcttccactccagcatcggatcccggaaaggcagcgtcggagatggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagccgagtgatttcacaggctgcacccaggttgtagacgtgggctcangccaggggcatctctcccgcttcatggctcttggcctggggttgatgtgaagaagcatcgaangggatcagagactggtggagagarcccagcgcctggaccaggagcttctgcangctctggagaaagaggagaagaggaacccgcagatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggasacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgaaaaaaaaaaaaaaaaaaattgctcggtc

SEQ ID NO: 4148 - DNA, 1384 bp, Homo sapiens
ggggaactgcagtgacagcaggagtaagagtgggaggcaggacagagctgggacacaggtatggagagggggttcagcgagcctagagagggcagactatcagggtgccggcggtgagaatccagggagaggagcggaaacagaagaggggcagaagaccggggcacttgtgggttgcagagcccctcagccatgttgggagccaagccacactggctaccaggtcccctacacagtcccgggctgcccttggttctggtgcttctggccctgggggccgggtgggcccaggaggggtcagagcccgtcctgctggagggggagtgcctggtggtctgtgagcctggccgagctgctgcaggggggcccgggggagcagccctgggagaggcaccccctgggcgagtggcatttgctgcggtccgaagccamcaccatgagccagcaggggaaaccggcaatggcaccaktggggccatctacttcgaccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtytttcaagcacaagaatccagcccctgacaactttcttctgccctctcttgccccagaaacagcagaggcaggagagagactccctctggytcctatcccacytctttgcatgggamcctgtgccaaacacccaagtttaagaraararyararctgwggcaggtatacagagctggaagtggaccatggaaaacatsgataaccatgcatcytcttgcttggccacctcctgaaactgtccacctttgaagtttgaactttagtccctccamactctgactgctgcctccttcctcccagctctctcactgagttatyttcactgtacctgttccagcatatccccactatctctctttctcctgatctgtgctgtcttattctcctccttaggcttcctattacctgggattccatgattcattccttcagaccctctcctgccagtatgctaaaccctccctctctctttcttatcccgctgtcccattggcccagcctggatgaatctatcaataaaacaactagagaatggtggtcaaaaaaaaaaaaaaaaaactcga

SEQ ID NO: 4149 - DNA, 1159 bp, Homo sapiens
tgattacgccaagctcgaaattaaccctcactaaagggaacaaaagctggagctccaccgcggtggcggccgctctagaactagtggatcccccgkkctgywggaattcggcacgagcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagakattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcakaactacccctggctcaccaaccacacggtgcagctgcagctccgcagcctggcacacaacctctcggtggtggccaccaatgacgtgggtgtcaccmgtgcgycgcttccagccccaggcccctcccggcacccatctctgatatcaagtgactccaacaacctaaaactcaacaacgtgcgcctgccacggkagaacatgtccctcccatccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgaktgtccagcgtgagcagtgatgaratctggctctgagccgccggcgagacaggagtattctcttggg

SEQ ID NO: 4150 - DNA, 1327 bp, Homo sapiens
  misc_feature (939)..(939): n equals a,t,g, or c
  misc_feature (1087)..(1087): n equals a,t,g, or c
  misc_feature (1296)..(1296): n equals a,t,g, or c
ctcgagttttttttttttttttttttgaattcagtcaagtttattaaacttgctgtgtgctcagcaccgccctaggcagtaacatgaaaaacattacaaaagaagatctcaacaagggaaaaatatattctgtactatattaatttccaatcatttacatgttgctttttaaagtgttcttaggtcactttggggtatgtggtctccttctttctccatgttcccctaaagcttccacactgttgaattatgtgcctgtggcgaccatcctccaggaagggcaccttcctgctgatgaggcaaccatgggttggtcagggctggggtcccgtggtggaggagacatgctgagagaaaaaccatcaaccccgagagctcaggacactcacagtgaatcccagaaggccaaacgtggggaagccacaaagagggctctgggcccctcactcaccccctcccctaggggatgtgcttaaagtgctaacgccgtaggaaaatgatgcatagctacaagccgtcctgggtgctactagactcatcgcctgcctcttcctccctaacttgtgctaatactgggcgatggcacaggccaatagaaaagtctagtgcccagtgaagtagtagagaaggtccaacgtgtaacctagaattcccaagaggaggtggggacagaagagaagaagtgaagggcagagacgtgtgcagcaaaaaggacgtttgtgcttggccggtaccgctgggtcaggggttggtttctgtgcaaagggcaattgggttctgcacagctagcagggtcctaaattttacctgagggaacaaggctacatagcataggaaggaggaaaatccatgcagggccctccctgtcccccacacaggcacgcccccatgcctactgtacaaggtgctgtggagtactggggtggggtatacagcagnccatgccacacttggatgctggatgacatctgaacacccctggccaaagagctccctctggaagggcccagtcatcacatgcagggcccaccctgagtcagcatgaggggcttacgtccaactggtagccttgccaaagatacctgtngcctgcgggttacagcccagtgaaatgcatcacgtgcatgacatggagggcaccccagccaggagggcaagcaaaagtggcagtggcataacttcttcacgttggtgacctagctaggtagaggatgccttggaggaatgggagggtgtccagaggccaagagaatactcctgtctcgccctcggctcagagccagatctcatcamctntcacgctggacactcgatagatatagcccag

SEQ ID NO: 4151 - DNA, 979 bp, Homo sapiens
  misc_feature (4)..(4): n equals a,t,g, or c
  misc_feature (29)..(29): n equals a,t,g, or c
  misc_feature (977)..(977): n equals a,t,g, or c
aaanaatttttccaaaaccctttttacgngcccacccattttcagaggccgcatggatccaatgtacgcttcttctgtatcccagaaggacaagtcagggtattcaccaggttccaggatgaaaggaacaccctgaaatccaggttcttcataaatcagccacgtgccccaatgtactttcatggaacaagtcttctgcattacaccaaatccctgcatttcttcagtatcatcaaagtaggaacttaggattcctaacccttctggttcagtaaataagtcaatgtgactaactctgtaatcctgaaccacatgtctgatggaaccaatcaccactggcttatcagactctgcttcttcgtgcctttccaaaatgtcttctataccccagagaccagagagttccaattctccttcttctaaggggatggagtgcccttcaaaatktggktgctcatacaaaatccaacatcctctaacaacttttatgagtatcactggagagaggctccaagaactgcaatcctgaatgtcactgaaaacttcaatgcacttctcagagacgtcgggttcactatatatcactacctttccaggtcggggattgagtttattttggacacttcctctaagtgtcattgtgtctgataatgacattccagaaaaagaaatgcttgggtcataccggcttgatttgaaaagacccatgaagtcggtgtcactgtttgcacagtttggcaagtttgatttaataacactttcaatatgattagccttttccatatcatcattcttcagttttgacaattcagaaaatttagtttctggcaagtgtaggttgcttcgtgaatccagatcttctttggttttctctttttgcgggtatttttccatgtggcttggacttttcaaactggagtgtratgcggacgcgtgggtcgacccgggaattccggaccggtacctgcaggcgtacntt

SEQ ID NO: 4152 - DNA, 1390 bp, Homo sapiens
  misc_feature (498)..(499): n equals a,t,g, or c
caagctctaatacgactcactatagggaaagctggtacgcctgcaggtaccggtccggaattcccgggtcgacccacgcgtccgggcctcagggtggacgcatggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaaytcacctgtcggggaaaattggagctaagaaactgcggaanntggaggagaaacaagcgcgaaaggcccagcktgaggcagaggaggctgaacgtgargwgcggaaacgactcgagtcccagcgcgaatgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcaaaaaaaaaaaaaaaaaaaactcga

SEQ ID NO: 4153 - DNA, 1696 bp, Homo sapiens
  misc_feature (117)..(117): n equals a,t,g, or c
  misc_feature (1660)..(1660): n equals a,t,g, or c
tggcggcggccgctgcggcgggacgagtctgggcaacggctgcggctaaagctgcagcggcccacggggggsctgcacgggggtagtagggggtggccctgaactggggcctggccntggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccaraggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttragacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgagrccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagacttttccactgcagcgactgagccttagggggacttttgcccagntgacaaagccggaagtcctgtwttaccagtggtatg

SEQ ID NO: 4154 - DNA, 658 bp, Homo sapiens
  misc_feature (6)..(6): n equals a,t,g, or c
  misc_feature (15)..(15): n equals a,t,g, or c
acgacnagacaggtnaccggtaccggaattacccgggtacgaacccacgcgtaccgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaaaaaaaaaaaaaaaaaa

SEQ ID NO: 4155 - DNA, 373 bp, Homo sapiens
ccacgcgtccggttctttgattgcttcataagaaaccggtgtattgctctgtgctgaggtcttagatatgttctagcactcaggagtccaaaccattgcttttgggttagaaatgcatgaaagaaacatgcacgtctatctgaactacaaataaactttctgcttaagtctacttaggctaatgttgaaacatttgttcattcaacacaaaccacatggtggcagaagaagagagaccctcattacaccacatagtagcaataggagctgcaatgtcacaatgagttttaaaaagaatgcctctttaaaagaaaaaaaaaaacaagaaagaaagaaaaaaaaaaaaaaaaaaaaaaaaaaaaaaaaaaaaaaa

SEQ ID NO: 4156 - DNA, 1603 bp, Homo sapiens
  misc_feature (328)..(328): n equals a,t,g, or c
  misc_feature (336)..(336): n equals a,t,g, or c
  misc_feature (341)..(341): n equals a,t,g, or c
  misc_feature (788)..(788): n equals a,t,g, or c
ggtcgacccacgcgtccggcccgccggctccggagcggctctgccttcccgagcgcgggaccgcgccctgggggaggagggcgaacgacgcggcgatggctccgcgggcactcccggggtccgccgtcctagccgctgctgtcttcgtgggaggcgccgtgagttcgccgctggtggctccggacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttngccamctngcttnaagaagaaaggctatcgttgtacaacagaagcagagcaagatatcgaagaagaaaaaggttgaaaagwtagrattgaatgacagtgtgaatgaaaacagtgacactgttgggcaaatcgtccactacatcatgaaaaatgaagcgaatgctgatgtyttaaaggcgatggtagcagataacagcctgtatgatcctgaaagccccgtgacccccagcacaccagggagcccgccagtgagtcctgggctttgtcaccaggggggacgccagggaagcacgtctgtggccatcatctgcatacggtgggcggtgtwgtcgagagggatgtgtgtcatcggtgtaggcacaagcggtggcactttataaagcccactaacaagtccagagagagcagaccacggcgccaaggcgaggtcacggtcctttctgttggcagatttagagtnacaaaagtggagcacaagtcaaaccagaaggaacggagaagcctgatgtctgttagtggggctgaaaccgtcaatggggaggtgccggcaacacctgtgaagagagaacgcagtggcacagagtagcaggtgagccgtggttttggtgacattgggggcagagtggtgcagggtgaggagaaggtacttggagcctcccaggtgctgtggcagcataggaatggtatttgacagggaagtgggagagctttccttgacccaggaagactgagggggactgaacatgattacttgtctgcctagagcttcttgtaaagaagtcacaaacttagtgcctccaggggcttggctgtgtgataatgaggatagaggattacttgtgaggcaatgtggcatggtggggattgtggcaaactagaattcacatcacccaccatatagggcttgcattaccacgaggcagaaagcacctagtgttgctgcatcttcttacgcaaaaaagacaaaatccagacttctaaaatgtaaaatcactgattttcgatattggcagcttactttttttttttaaacaaccatgcaggccaaatgacttgtaatcttgtcaccatttttaggtaaactgtgacttgaaaaagtctggagcaaacaaaccaatgctttttccttttattctgttggraaccagttttctttgtgtcacagttytgaaacctcaatacgaatatttctcttcccaccaaatattttgaggcaattgaaaagccacagtgatttatttcttgatttggcaattttaattttgcaagacaatt

SEQ ID NO: 4157 - DNA, 1292 bp, Homo sapiens
  misc_feature (488)..(488): n equals a,t,g, or c
tcgacccacgcgtccgactacttttataatcagaaaataggatatatagaaatggtctggaaaaaatgaggagagaagttacaatagggaggtcatcttcaatctgtttggaccagcaagtaaaagcaggaaatgctgtccaccaccaatggcttaaatatgtgtgttggatggtggtggtggttggtggttctggggttggggatggggggaaccttgggatgtgatggttttcttagtcagagatggtgctttacagctgggaagtatcttgaacttggtggaggtctatccagacatcaggcagatttcatattttcacagacaaaggctacgtttacgtctaaggggaaaacacaaaatactaagatagaaacctccatgccccctcaccttttcagacaacaagaacccccagggcagagggtcttcctcactctcagagttactttgacttctcatctggtttcgtgtgggtaatgcatttncactcttgagtttcttttctttttaaggtattttcattatgacgtttgttcttttgcaaagagctaattctgcagaattctacccagggagggccgagggaagttagtgaaggtaacgataccagttagaaagttgagtttgggtcatctcaggggcctcctttggcctcctttggcttatgttctagagatggcccttacttcccaggaatagatagtgatgtcttactgagttgcaggtagagtctgtattgaagcgcaagattttcttccctgacttgtctgggaatccttacccaggactgtggctttcctcttccatatccctccaccaggargcaggctctaagcctctgtgctgtcatccttttgccacttccatgaacatgccttcaaatacttgaaaaagtcactatagcgtaaagtatacttttctcttttggtgatgcttttctgcattttctctataaccagagagtaagaataaaactacagcttgggacctggcgcggtggctcacacctgtaatcccagcactttggaaggctgaggagggtggatcacctgaggtcgggagtttgagaccagcctgaccaacatggagaaaccccgtctctactaaaagtacaaaattagctggcatggtggcacatgcctgtagtctgagctactcgggaggctgaggcaggagaatcgcttgaaccttgggggtggaggttgcagtgagttgagatcttgccattgcactccagcctgggcaacaagagtgaaacgccatctcaaaaaaaaaaaaaaagggcggcc

SEQ ID NO: 4158 - DNA, 687 bp, Homo sapiens
ccacgcgtccgctcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccaaaaaaaaaaaaaaaaaaaaaaaaaaaaaaaaaaaaaaaaaaaaaaaaaaaaaaaaaaaaaaa

SEQ ID NO: 4159 - DNA, 1297 bp, Homo sapiens
cgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaagcgccgtcagcctccgactccgactccaaggccgattcggacggggccaagcctgagccggtggccatggcgcggtcggcgtcctcctcctcctcttcctcctcctcctccgactccgatgtgtctgttaagaaacctccgaggggcaggaagccaacggaaaaacctctcccgaagccgcgagggcggaaaccgaagcctgaacggcctccgtccagctccagcagtgacagtgacagcgacgaagtggaccgcatcacttaatggaatcggcgggacaagcgcggaagcgccaactggaagcccggcggcggcgaaagcagaagaggagctgcggcgcctgcgggagcagaaaagaagagaagaacggagcgcgaacgggccgaccgccgggagctactgggcacggcggcacaccgggacgaactcacggaagacatacccgtccataaccgggaccaaggccgggccgggtcccctctcctctgactcgaacccagcgactgataatagccaaatctctaaacgcatctctacccaaacccgccagaaactgcctagataaaaaattcgg

SEQ ID NO: 4160 - DNA, 1048 bp, Homo sapiens
  misc_feature (1038)..(1038): n equals a,t,g, or c
tcgacccacgcgtccgacttttccatgggtcaaattttttgtgtgagagatagaggtacatgtcttctgatgatgtgctgtrgaatgcaatgtgggaaacctacatctggctagtgcttacatttgctcaaaaagcatgttgtatgaagctgactgccaccatgctaaagcagattcatattaagaagtgtcggtcgatccagtggctcttaagagtgaatagctttatggaatcaagtatgtccctgagtagcaagattaggcctcaccaaagaagaaattaacctgcactttcaaaaagtaccatgtataggaatgaaacattgaggtcccactttattctgtctttagtacatggtyttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaattctgctgccctccaccatttatttttacagtgctttgtaatttttttcatcagttccttaaatgwtatttggaggaaactaagttcttgacctcagtaattytattyytgcttttccctaaatgtttccctactagtctttttggaaaacatgtttgttttaatttcatcttccctcactttatttaggtagaatttttcccccttcatttctgaaattttttgctcaccgncatgtttaaa

SEQ ID NO: 4161 - DNA, 3227 bp, Homo sapiens
ccacgcgtccgcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggaactgattacatatgtatccagaatgtattccaagtggcaggcagctcttggctttcctgtattcgacaaagttgcttctccaggtatcagctggagaacagtggtgtgatcatagctcactgcagcttgaactcctgagctcaagtgatccttgtgcttcagcctccctagtaggatttcagtcttagaaaggtgatcacctggtgatgctcctttgctttatatctgaagaaactgagacccagtggaatcaagaaagggaatcaactgctccttccatggagttcccaaaactcttggcttatgattgtgctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaggcttgatggacatttctgcagaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagcccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatggttccaacaaattgcaaataaaactgtatggaaacgaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4162 - DNA, 580 bp, Homo sapiens
  misc_feature (425)..(425): n equals a,t,g, or c
  misc_feature (517)..(517): n equals a,t,g, or c
  misc_feature (564)..(564): n equals a,t,g, or c
  misc_feature (577)..(578): n equals a,t,g, or c
gcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccragaaggaraggcgctatgcccgcaagattgagcccatccggcgcaagggcaactaccttctctgctcgttgctcctagggaacgtgctggtcaacacctccctnacaatccttctagacaacctcatcgggtccggcctcatggcggtggcctccttcaccattggcatttgtcatctttggggagatcctacctnaggcccctgtgctccccgacatggggcttggcttgtggggtgccaancaccatgcttttnncc

SEQ ID NO: 4163 - DNA, 3101 bp, Homo sapiens
  misc_feature (8)..(8): n equals a,t,g, or c
ttttgggntaggtgacactatagaaggtagcctgcagtaccggatccggaattaagggtcgacccacgcgtccggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtastactgtactaagagctctgccctcatgtgaattcctgccctggcgcctcttccctggggctgaatcaggccctgctgcaaaactccaggcttcccagggttggggaggctgtgggaccaargtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaatcctggtgaatctacaacttgcctgtttgttctgtcagtattcagtatgttgttgagataaaagtggctgtggctggctgtctcttgtgatgggacaagggcaataaaggattctaggaccattcagcagtgaaatgcaatcagaaatggaatttctaaatatagtcaaggctgtcgtcacaggagtgagagggacgtggctgctggcagacatacaggacagatgtgctcagctgccataagcatgagtcctgtgaaacagatcccatagsgcccttggcttgtgagtactggaagggcagtgggcttcagcaaattgcccctcctccctacccatgggactgaaagaagcttgatccaaaagtatgagtaatattgttttataacatgcagctgccttttcgtccacacctacaggctagtggtttcaaagttggagtgttcatcccttgaagaacctgagttacgtcactatacccactctcaaagttgcagctctgcaggggactcccatggtgctgtacaggtgctgcaggctggcttgtgcgattgagtgtgctgaggccaggggctccaagcatgcaaagttcaatggagtagacaaactgggggcatgttttccaagtttgatccaattgttcttccacctgaagctttactcccagaaagttagttataggttgttttccaaggaagcctgagacaaggaaaaagtaacctgttgaaggtgagagctctgtctctaaatccatggggagtttttcctggcttttctctggaactgttgtttgttaatgacttttaggcacatgactcatttcaagcatgtcatccattctatttcaatgtcagtattttatcttgacgtggagacagaagtgagaactaaaggagctgaatctattgtaatgtttgcactttttttttcttcagaggcatgatgttgcagtgcaaaggcccagtaatgtctttattgcttctgctggcggcttactctgtaatctgcaaaagtaaggtaaactcaaagggcacagaacatcacc

SEQ ID NO: 4164 - DNA, 2235 bp, Homo sapiens
  misc_feature (867)..(867): n equals a,t,g, or c
gagcggaccgggcgctcgcaggccggggctgtatggggctcccgcgcgggtcgttcttctggctgctgctcctgctcacggctgcctgctcggggctcctctttgccctgtacttctcggcggtgcagcggtacccggggccagcggccggagccaggtaggggctgccgagcgcagagcggggagggcgcaggggcgaccagggcgcggggagggtccccagcccagggctccccggcggcccgcagccctcagcccaacctccgcgtggacccctctggggcagctctcagcgaggactcggccgcggccctttgtcgccagaaccctctcccagccttgacctygcgmtgcccggaccccgmggcctttrcctgggtccaaggaagamctcgcccctgtkcactggmgamccgccccggtgccccttgttggtgaagtcctccccggcctgataagtacactttctattgtcgaaatctggctgggtccccgaagcagataaaaacttccttttttgtcgggaactctccctcggtaacgtcagattctgctttttgggcaggggcccaagtctccggtttccaacttcgcggggamcctccgtcgggccgcggccagtcgcctttcccgcccgctgcggtctctgtccgccccgcgcccgctcccttctccccggcttccgctcgccgtgtctggataagcccagtgcgggcgcgatccgcgaagaggcgggcgcccgwgggaaagaggggygactcctggctccatccgcgttctcctccccgcgccgcgtcctgcgctccactccctcctcctccctaggcactttcctgggtgtcccacgaggagaacctgggagccggnctctagcaggtggwggttccggtgactgaagaagccgcaaaacgatttcgcttagcttaagaaaggcggaccaagccgtgcgaagtctgggtttgggaggagggaagggcccggcagcctcagggagaggcctycagccccagcctttcccttcctggagcttttccatctgcgcaccccctaccaaccttgctggggggctaacgggatgaaaacaaaataagkatctggtctycacaratgctgtcaaaggrtacaccaaaagttgcagaacaatgtgaaacagcttgccagtgatcaggagtccagcactcttagaacaaagggtgcttgccccgcacggtgacttaacgcctgtagtccaagcactctgggaggcggaggtgggaggatagcttgaggccaggwwttcgaggctgtgagctgtgattgcactactgcattccagcctggttgacagagcgagaccctgtctcaaaagaaaaggaatccttgtcacttttatgtaaagatgtttaaaacacaaagtatctcaatgcaaagaaataatacatgtttgatataagcctgggcaacatggcgaaacctcgtctctaccaaaaatacaaaacttatccggggatggtggtgcatgtctgtgcttccatctatctattccgggagctgaccaagaagatcccttgagtctgggaggtcgaggctgcagtgagctgtgatcgcgccactgcactccagcctgggcaatacagcaaggtcctgtctccagaaaaaaaaaaaaaaaaagttcgaggtgatggatatgctaattagctggtttgattattacacattacatacacgtattgaaatatcacactgtggccgggcgcggtggctcacgcctgtagtctcagcattttgggaggccgargcaggcggatcacgargtcaggagatccagaccatcctggctaacatggtgaaaccccgttctactaaaaaatmcaaaaaattagctgggcgtggtggcgggcacctgtagtcccagctactcgggaggctgaggcaggagaatggcgtgaacctgggaggtggagcttgcagtgagccaagatcgcgccactgcactccagcctggtgacagagcgagactccatctcaaaaaaaaaaaaaaagaaatatcacactgtaccgtatacatatgtgcaagtatgtgacaattaaaaataattttacaaaaaggaagagacctgatctagcaactcagccccactctgcatgtgacgtcctgccccaccaacaccaaggccctctggctgccctggaccactgcctatggggtagccctgctccacaaggagcagaaaaaaaaaaaaaaagggcggccgc

SEQ ID NO: 4165 - DNA, 1111 bp, Homo sapiens
ccacgcgtccggccgcaggaacgggctccgcggacgacgggctccagggacgcacaggcagcgggcctcccaccgcgggtgccgggggcgggggggctgcccccatgcggggcccttcctggtcgcggcctcggccgctgctgctgctgttgctgctgctgtcgccttggcctgtctgggcccaggtgtcggccacggcctcgccctcggggtccctgggcgccccggactgccccgaggtgtgcacgtgcgtgccgggaggcctggccagctgctcggcactctcgctgcccgccgtgcccccgggcctgagcctgcgcctgcgcgcgctgctgctggaccacaaccgcgtccgtgcgctgccgccaggtgccttcgcgggagcgggcgcgctacagcgcctggacctgcgcgagaacgggctgcactcggtgcatgtgcgagccttctggggcctgggcgcgctgcagctgctggacctgagcgccaaccagctggaagcactggcaccagggactttcgcgccgctgcgcgcgctgcgcaacctctcattggccggcaaccggctggcgcgcctggagcccgcggcgctaggcgcgctcccgctgctgcgctcactcagcctgcaggacaacgagctggcggcactcgcgccggggctgctgggccgcctgcccgctctagacgcgctgcacctgcgcggcaacccttggggctgcgggtgcgcgctgcgcccgctctgcgcctggctgcgccggcacccgctgcccgcgtcagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgccgccgcctccgcaccgccgccctccgcccgccgagaccgtccagacccgaaccccgatcccgacccccacggctgtgcctcgcccgcggacccggggagccccgtccgctgccgcccaagcctga

SEQ ID NO: 4166 - DNA, 1109 bp, Homo sapiens
ccacgcgtccggccgcagaacgggctccgcggacgacgggctccagggacgcacaggcagcgggcctcccaccgcgggtgccgggggcgggggggctgcccccatgcggggcccttcctggtcgcggcctcggccgctgctgctgctgttgctgctgctgtcgccttggcctgtctgggcccaagtgtcggccagggcctcgccctcggggtccctgggcgccccggactgccccgaggtgtgcacgtgcgtgccgggaggcctgccagctgtcggcactctcgctgcccgccgtgcccccgggcctgagcctgcgcctgcgcgcgctgctgctggaccacaaccgcgtccgtgcgctgccgccaggtgccttcgcgggagcgggcgcgctacagcgcctggacctgcgcgagaacgggctgcactcggtgcatgtgcgagccttctggggcctgggcgcgctgcagctgctggacctgagcgccaaccagctggaagcactggcaccagggactttcgcgccgctgcgcgcgctgcgcaacctctcattggccggcaaccggctggcgcgcctggagcccgcggcgctaggcgcgctcccgctgctgcgctcactcagcctgcaggacaacgagctggcggcactcgcgccggggctgctgggccgcctgcccgctctagacgcgctgcacctgcgcggcaacccttggggctgcgggtgcgcgctgcgcccgctctgcgcctggctgcgccggcacccgctgcccgcgtcagaggccgagacggtgctctgcgtgtggccgggacgcctgacgctcagccccctgactgccttttccgacgccgcctttagccattgcgcgcagccgctcgccctgcgggacctggcccgtggtttacacgctcgggccggcctccttcctcgtcagcctggcttcctgcctggcgctgggctctgggctcaccgcctgccgtgcgcgccgccgccgcctccgcaccgccgccctccgcccgccgagaccgtccagacccgaaccccgatcccgacccccacggctgtgcctcgcccgcggacccggggagccccgtccgctgccgcccaagcctga

SEQ ID NO: 4167 - DNA, 569 bp, Homo sapiens
cccgggtcgacccacgcgtccggcaggcagcagggaaggaagcagaggcttcctaaggctgttttcttagccgtggagaagcccgcgctttctacatgctcccaagtgctgtcatgagcacgttcctgacaagtcaggtgttcagattgcagtccctggccaacgtcaggattcttacaggttgaatgttaagctcaccgatcttggcctcaggtcctgcctggcttgcctgctcattttcacacgtgcagtggtgggtctgtctcatagcacaggtgcagtttagtgcagccacagtgtccccaggcagggcggggactggagcagcccccagtgtgccagcagtgtgggcagcggaggctaggggcccatctgtccctagcaccctccagggcagtcccgttttgcagcgggatttggcaaacccccctccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccc

SEQ ID NO: 4168 - DNA, 721 bp, Homo sapiens
  misc_feature (470)..(470): n equals a,t,g, or c
gtctgagatcatgctggcaaaagtgagtcaggagaggagggcttaaaaaggagccaggggctgagcacagtggcttacggcctgtaatcccagcactttaggaggccaaggtaggcggatcacttgagcctaggagttcaagaccagcctggccaacgtagcaagaccccatctccaaaaagaaaaaaaaaatgtggggggagccaggaggtagagtctctgccctggcccaggtatctgcagggtatgcaccatctgggagtcagaagtgctttctacaaggcctgagggtcttgttattggtggtacagctctctgccccccacctctgccccaaccccaactcatgccaagttctggcctcctacttctcatgtctgtattcctactgggatacaatagaatcccccagggctgtgggttcacacctcaggggcagatatattggktctagctaagccagaacttangaggagaaagtatctggagaagatttctagaactcagaactgtgcttagaggctggccagcgaccccttggtcagtgcctatcatgtgggccttccagtccgggcagcccgtgagggcatctgaccgctccctgacatctgcctccacccccaatgcccccccagggaatggtgtaagtccctgatgctgtctcgaacccacatctccccgaccctgttctccctgataaataaataaaactgtaaataat

SEQ ID NO: 4169 - DNA, 715 bp, Homo sapiens
  misc_feature (21)..(21): n equals a,t,g, or c
  misc_feature (26)..(26): n equals a,t,g, or c
  misc_feature (30)..(30): n equals a,t,g, or c
  misc_feature (40)..(40): n equals a,t,g, or c
  misc_feature (69)..(69): n equals a,t,g, or c
  misc_feature (149)..(149): n equals a,t,g, or c
  misc_feature (699)..(699): n equals a,t,g, or c
tggttcttaaaaactccttanccttnaagntgatccaacntgcctgggcttcccaaagtactgggattnataggcttgagccaccacgcccggctggttccatgcatcttacctggatgaacttgggtccctaaatgggcccctgggtncccagcctcccctcctccaatacattctctgataatctgaccttgtcatgaccattggggcacctgttgcccacagggtagaggccaggtgcctgaggacagcactgaaggccgtgcacctccacctccagcctccagtcacctcacctagctcactgctctctctcctgcaaagtctctcctgcttccctccctaagggaagggctggccgctcactgcttgggcccccttgatttctaagacacctgtgaagggtcccacaaggccaggcacagtggctcttgtctgtaatcccagcgctctgggaggctgaggcaggaggatcacttgaggtcaggagttcaatgtggacaacacagtaagaccctgtctctacaaaaaaatttaaaacttagctggcattggtggcgcatggctgtagtcccagctacttgggaggttgaggtaggaggatcgcttgaacccaggagttcaagtctgcagtgagctatgattgcaccactgcactccagcctgggtgatggagcgaggccccaactcaaaaaaaanaaaaaagggcggccgc

SEQ ID NO: 4170 - DNA, 403 bp, Homo sapiens
  misc_feature (391)..(391): n equals a,t,g, or c
gcaagaatgggatgaattttatcttactcatttcctggaggaattttgacaaagcagagacgaagcgctcattctctcacctgccgccgccctgtgaagaggtgcmwtctgcatrgttgcaaatttcccgagacctccccagctacgcagaactccaatgttggtgtcaaatttaaaaaattgatttggcaagaacacataatggattgtgctgtgtgctctgtactgtctcatgcctggaggcacaccatgtttggctgtcccttctgctaacactgagattaaactgtggatttggtaccaggaatggtggctcmtgcctkktwataccasactttgggaggctgagaacagctgatgggcaaccagtttgaagacccccaacagaggnactgagtcgggc

SEQ ID NO: 4171 - DNA, 202 bp, Homo sapiens
  misc_feature (190)..(190): n equals a,t,g, or c
ttcttcctcttcctgtcccatgacttcacgctgcactcttcaaccaatcaacgatctccacactttggcccactcccaaacccttaaaaaccctagcccccaactcttcagggaggcagatttgaggtttcctcctatctctgcatttggcagccctacaatgaaacctctttgtctgctgcaacctggngtctcagcctat

SEQ ID NO: 4172 - DNA, 1147 bp, Homo sapiens
  misc_feature (1146)..(1146): n equals a,t,g, or c
gaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaaaaaaaaaaaaaaaaaaaaaaamctcgrgggggggcccggtacccaagggcggagcang

SEQ ID NO: 4173 - DNA, 769 bp, Homo sapiens
  misc_feature (1)..(1): n equals a,t,g, or c
  misc_feature (4)..(4): n equals a,t,g, or c
  misc_feature (20)..(20): n equals a,t,g, or c
  misc_feature (38)..(38): n equals a,t,g, or c
  misc_feature (85)..(85): n equals a,t,g, or c
  misc_feature (649)..(649): n equals a,t,g, or c
natnctacgggaatctcctnttgggttcagaagccggncctccaccgcggtggcggccgctctagaactagtggatcccctgggntgcaggaattcggcacgagcaataattggaatttttaaaatcaagatgatctgcttatccagtgattgccattagcaatgaagaaagaaatggttttgttgacaactacttatttctctctccatgtgaaagtgtttttttgtttgtttgtttgtttttcaattctgtcatcatcgagacgtggatcccttgctaacaacagttcctggtgactatagaaattaagactccttagaagaaaaatgttattattacaattcaaaaaagaaacaaatgtgctcacctgttggtgggaggacaactgaaatttgcatgtcaactgtaaacatctgaaagataaataagagaggaaagaaagtttatgatacagataacagattgctagtacagagctgctttttcagaacctctcctttattaccagtatttttcccccctttttaaaaaaaaatctaaacaattagatgtcaagcattgggtgaaaaacacataacaaaagattctggcttttgctcatcattctgatctccctgctctgcatactgaagccccacttccttttgntgcctcccagtggaatttcagccactcagaccagtcaggggwgtgttggcagctatcctctttgaatggkagagagtacatttattctttgcacagaaggaacatgaaaawttggtttga

SEQ ID NO: 4174 - DNA, 1147 bp, Homo sapiens; identical to SEQ ID NO: 4172
  misc_feature (1146)..(1146): n equals a,t,g, or c

SEQ ID NO: 4175 - DNA, 253 bp, Homo sapiens
  misc_feature (114)..(114): n equals a,t,g, or c
ccatgaatttgctaatccataggaagttccattaagaaactccctagttcatcattcatagtatttcacctgtagctcttaatccccaggcccatgacttgcccttctctcttntgagttgtgtgtcagtcttcaacctacggtccttcccgactatggactcatgtacaactctgaatgaaactagcatctttcaaagaagagtctagttttcttcctggtcctgtacccctctgtgtttcgttgtactaga

SEQ ID NO: 4176 - DNA, 472 bp, Homo sapiens
  misc_feature (425)..(425): n equals a,t,g, or c
  misc_feature (447)..(447): n equals a,t,g, or c
aattcggcacgagcaaaaaccactcggtcaatgaagaagagcaggaagaacaaggtgaaggaagcgaggatgaatgggaacaagtgggcccccggaacaagacttccgtcacccgccaggcggattttkttcagactccaatcaccggcatttttggtggacacatcaggtttgtgcttttctggaataacttaatatttgccttttctagggttttgccatgttggtgaagggggaaggtgtgaggcttgttttgagacttcttggacgtaatggtttgcatcttgctcccctgcctgctcttctcttgcacttcctgatgcttcccttgtcagcccccgtggsttattctctccctgctggsgsatgtctgcargggacagggagctcctccttctactctgtcaagttcagtggttcactgntagggggtaagggaaagccagntaattggccatagggggggtcagcc

SEQ ID NO: 4177 - DNA, 952 bp, Homo sapiens
gaattcggcacgaggccctggaagctgcctgtccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggaagccgatagtcaagttcccgggggccgtggacggcgcaacctataatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaatcatccacccaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4178 - DNA, 1135 bp, Homo sapiens
gcttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctstctgtgaccgaaccctcccaaggccgagtggcggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccawaaaaaaaaaaaaaaaaaaaaaaactcgagggggggcccggt

SEQ ID NO: 4179 - DNA, 837 bp, Homo sapiens
  misc_feature (817)..(817): n equals a,t,g, or c
  misc_feature (835)..(835): n equals a,t,g, or c
gattatatataggtgcctgctaaaaatgaggagatggtaatattttcacacacaaagggaactctcatacactcttggtgggaatgtaagttggtacagccattatggaaaacagtatggcagttcccctaaaaacagaactaccatatgacccagcaatccctctgctgagtatcccaaaggaaatgaaatcagcacttcatagagatatctgcattctcatgctcactgcagcattattcacaatagccaagacagagaaacaacataagtgcccatcaatagatgaacagataaataatttgcagtatatatgtacaatggaatatcattcagccttacaaaaggagatgctgctatatttgcaataacatgggtgaacctggaggacgttacgctaagtaaaataacaatattgaaggaaagaaataatactgaaagaaaaatattgcttgatctcacttatatatggaacttaaaaactacacatagaaacagggtagaatggtagttatccaggctgggaggaagagaaaacaaggagatgtaggtcaaagggtacaaacttgcagttctattggatgaatgtctagagagctaatgtacagcatgagaactatagttaatattgkatatggaaaatttgctgagagactagattttaggtattctacctcaattaaaaaggtaattgtggccaggcacggtgggcttacgcctgtaatkccagcactttgggaggcctaagcgggaggatcacgaggtcaggagatcgagaccacagtgaaaccccgtctttactaaaaatacaaaaaanaaaaaattagccgagtgngg

SEQ ID NO: 4180 - DNA, 1097 bp, Homo sapiens
ggcacgagattatatataggtgcctgctaaaaatgaggagatggtaatattttcacacacaaagggaactctcatacactcttggtgggaatgtaagttggtacagccattatggaaaacagtatggcagttcccctaaaaacagaactaccatatgacccagcaatccctctgctgagtatcccaaaggaaatgaaatcagcacttcatagagatatctgcattctcatgctcactgcagcattattcacaatagccaagacagagaaacaacataagtgcccatcaatagatgaacagataaataatttgcagtatatatgtacaatggaatatcattcagccttacaaaaggagatgctgctatatttgcaataacatgggtgaacctggaggacgttacgctaagtaaaataacaatattgaaggaaagaaataatactgaaagaaaaatattgcttgatctcacttatatatggaacttaaaaactacacatagaaacagggtagaatggtagttatccaggctgggaggaagagaaaacaaggagatgtaggtcaaagggtacaaacttgcagttctattggatgaatgtctagagagctaatgtacagcatgagaactatagttaatattgtatatggaaaatttgctgagagactagattttaggtattctacctcaattaaaaaggtaattgtggccaggcacggtggcttacgcctgtaatgccagcactttgggaggcctaagcgggaggatcacgaggtcaggagatcgagaccacagtgaaaccccgtctttactaaaaatacaaaaaaaaaaaaattagccgagtgtggtggggagcgcctataatcccagctgcttcggaggctggggcatgagaatcgccggaaccggggaggcaggggttgcagtgagccgtgatcgtgccactgcactccagcctggacgacaaagcgagcctccatctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4181 - DNA, 1034 bp, Homo sapiens
gaattcggcacgaggaaccaccttctgtaggacagtcaccaggccagatccagaaggcttgaggccctgtggtccccatccttgggagaagtcagctccagcaccatgaagggcatcctcgttgctggtatcactgcagtgcttgttgcagctgtagaatctctgagctgcgtgcagtgtaattcatgggaaaaatcctgtgtcaacagcattgcctctgaatgtccctcacatgccaacaccagctgtatcagctcctcagccagctcctctctagagacaccagtcagattataccagaatatgttctgctcagcggagaactgcagtgaggagacacacattacagccttcactgtccacgtgtctgctgaagaacactttcattttgtaagccagtgctgccaaggaaaggaatgcagcaacaccagcgatgccctggaccctcccctgaagaacgtgtccagcaacgcagagtgccctgcttgttatgaatctaatggaacttcctgtcrtgggaagccctggaaatgctatgaagaagaacagtgtgtcyttctagttgcagaacttaagaatgacattgagtctaagagtctcgtgctgaaaggctgttccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactgctgccctgaggtcctggggctgcactttgcccagcaccccatttctgcttctctgaggtccagagcatcccctgcggtgctgacaccctctttccctgctctgccccgtttaactgcccagtaagtgggagtcacaggtctccaggcaatgccgacagctgccttgttcttcattattaaagcactggttcattcactgaaaaaaaaaaaaaaaaaaaactcga

SEQ ID NO: 4182 - DNA, 1032 bp, Homo sapiens
  misc_feature (5)..(5): n equals a,t,g, or c
  misc_feature (593)..(593): n equals a,t,g, or c
ggcanagggaaccaccttctgtagaacattcaaccaggcccagatccagaaggcttgaggccctgtggtccccatccttggggagaagtcagctccagcaccmatgaagggcatcctcgttgctggtatcactgcagtgcttgttgcagctgtagaatytytgagctgcgtgcagtgtaattcatgggaaaaatcctgtgtcaacagcattgcctctgaatgtccctcacatgccaacaccagctgtatcagctcctcagccagctcctctctagagacaccagtcagattataccagaatatgttctgctcagcggagaactgcagtgaggagacacacattacagccttcactgtccacgtgtctgctgaagaacactttcattttgtaagccagtgctgccaaggaaaggaatgcagcaacaccagcgatgccctggaccctccccctgaagaacgtgtccagcaacgcagagtgccctgcttgttatgaatctaatggaactttcctgtcatgggaagccctggaaatgctatgaagaagaacagtgtgtccttcytagttgcagaacttaagaatgacattgagtctnaagagtctcgtgctgaaaggctgttcccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactgctgccctgaggtcctggggctgcactttgcccagcaccccatttctgcttctctgaggtccagagcatcccctgcggtgctgacaccctctttccctgctctgccccgtttaactgcccagtaagtgggagtcacaggtctccaggcaatgccgacagctgccttgttcttcattattaaagcactggttcattcactgaaaaaaaaaaaaaaaaaaaa

SEQ ID NO: 4183 - DNA, 815 bp, Homo sapiens
  misc_feature (45)..(45): n equals a,t,g, or c
  misc_feature (712)..(712): n equals a,t,g, or c
  misc_feature (748)..(748): n equals a,t,g, or c
  misc_feature (783)..(783): n equals a,t,g, or c
aggcccattgccacattagtaggtctcactgcccgacactcaggntgaaggacacctgtggagggtgggaaccaacctctgccctcgggtcatcaactctgagccatgtgccacattrcttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacaggatttgtttccataagagcttttcttaccctaaaaatgccaagcctggtggccctcctgctgcttgattgcaggaagttctnccccaatgtcaatcctgccttagtccagagcagaangcaagctggtgagaccagggaggaagctggaactnggacacacaaggaccatgactgtattttagaa

SEQ ID NO: 4184 - DNA, 1503 bp, Homo sapiens
  misc_feature (1363)..(1363): n equals a,t,g, or c
  misc_feature (1447)..(1447): n equals a,t,g, or c
  misc_feature (1451)..(1451): n equals a,t,g, or c
  misc_feature (1456)..(1456): n equals a,t,g, or c
  misc_feature (1488)..(1488): n equals a,t,g, or c
  misc_feature (1490)..(1490): n equals a,t,g, or c
ggcggaggctgcactgagcgggrctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggractcaaagttggcattcccgtcacggatgagaatgggaaccgcttgggggagtcggcgaacgctgcgaaacaagccatcacgcaagttgycgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccytttaaagatccacattagccttttagaataaagctgctactttaacagagcacctggcgtgggccaagtgcctgatactcccttacactgaatcatgttatgatttatagaaatacctttcctgtagcttttatagtcattggttttcaaagacgatataccagccctyacccaggttttaaaaaagcactggtaggcatagaataggtgctcagtatatggncagtaaatgktctattgattatcaatcaagtgaaaaaaggaaatctggttaaaatactgaattttcatctcaacttcccattgncaantcaanggagatctcaacaatggaactggggaaaaatncnaaaagctctgggc

SEQ ID NO: 4185 - DNA, 1685 bp, Homo sapiens
  misc_feature (1105)..(1106): n equals a,t,g, or c
  misc_feature (1605)..(1605): n equals a,t,g, or c
  misc_feature (1613)..(1613): n equals a,t,g, or c
gaattcggcacgagtgatcctgatgtctgttaaagtttgagagccactgtagtttctgatgcagtagttctgggttgcggcctgagaatgtgcatttctaattagttcctaggtgatggctgcagctgctgtagcactttgagaaccactgtcacggcagaagcttcatcctcctcctcatccatacaagcgtcattccattctctagctcttcctctaatgtccattcttgcctgatgatcaagatattgggtctgcgtcctagacagctgtggcatgttgatttgtttgtctgtatgtctttctgtctcttgctctcattttcttcccctgtgaacargactctccatttctaagcccaacatgatctccttactggagcaagggaaggaaccgtggatggtggagagaaagatgtcacagggtcactgtgcagactgggagtcttggtgtgaaattgaggaattatctccaaaatggttcattgatgaagatgaaatatcccaggagatggtaatggaaaggctagcaagtcatggccttgaatgctccagtttcagagaacctggaaatataagggtgaattysakctacatcagggaaatgckgagaggcatttcatgcaagtgacarctgttaakgaaatctctactgggaaaagagacaatgaatttagtaattctgggagaagcatacccctgaaatcagtatttttaacacaacagaaagttcctaccatacagcaagtacataaatttgatatttatgataaactcttcccccaaaattcagtcataattgaatataaaagactccatgctgagaaggaatctttgataggtaatgaatgtgaagaattcaaccagagtacgtaccttagtaaagatataggaattcctcctggggagaaaccttatgaaagtcatgatttttcaaagctcttaagtttccactcattatttactcaacatcagaccactcattttggaaaattaccccatggatacgatgaatgtggtgatgcctttagctgttactcattctttactcaacctcagagaattcacagtggagaaaaaccatatgcatgcaatgactgtggwwnngcctttagcccgacttctttctcagtgaacatcaaagaactcatattggggagaaaccttatgaatgtaaggaatgtaacaaagctttcagacagagtgctcaccttgctcaacatcagaggatccacactggagagaaaccgtttgcgtgcaatgaatgtgggaaggcctttagccgttatgccttccttgttgaacatcagagaattcacacaggtgagaaaccatatgaatgtaaagaatgtaataaagccttcagacagagtgctcaccttaatcaacatcagaggattcacactggagagaaaccctatgaatgtaatcagtgtggaaaagccttcagcagacgcatagcccttactctacatcaaagaattcacacaggagagaaacccttcaaatgtaagtgaatgtgggaagacctttggctatcggtcacacctgaatcaacatcagagaattcataccggagaaaagccctatgaatgcatcaaaatgnggggaagntttttaggactgacttacaacttaatcgacattattggaattcacactggagaagagaccatttgaatgcag

SEQ ID NO: 4186 - DNA, 233 bp, Homo sapiens
  misc_feature (64)..(64): n equals a,t,g, or c
ccttataaatgtaacgaatgtgggaataattttagctgtgtctcagcccttagacgacatcagngaattcataatagagaaacgctctgattataacaagtataggaaagaaaacatgtggttaccactcaatccttattaaatattagtgagttctttttggttagtaaaaaaaaaaaaaaaaaaaaaaaaaaaaaaaaaaaaaaaaaaaaaaaaaaaaaaaaaaactcgta

SEQ ID NO: 4187 - DNA, 664 bp, Homo sapiens
ataaataatccttactgagtgctttgaatctctgaaaagagagcgagcatacaattgttagacatctttacacctgccctcatgttatctaataagcccattatggagtttaatacaagaaatatataacaaaattgtagaacgtagaaatatataaaatccgggatgagccagaatttaccttgtaactagaattacttcatttataatctataatgctacagatgtatattctcaatagtatcaaataggtttattttttccaacccttggatttcttcttgcatcttcaccatctctaagcaaagtgattccatagctaaaaggcagaaatgtgaattcttcttcaaacttgttaatacatgttgaacaagatgctgataaacccaatctctaaaaatatgaaatatctgatattttgtaactataaaaaatcttaaaaagggaaacaaatccaaactaagaagtatagatttaatataggcattgaatgctattgccattcataacgtcttatttttatgattaaatttatcccgatctgcatttgractttacacatgtaattgaatatttcaaaatgaaatctgtttacaggtacttaagagacaataaaggcaatgactgtagacttttaaaaaaaaaaaaaaaaaaaaaaactcga

SEQ ID NO: 4188 - DNA, 573 bp, Homo sapiens
  misc_feature (231)..(231): n equals a,t,g, or c
  misc_feature (559)..(559): n equals a,t,g, or c
  misc_feature (565)..(565): n equals a,t,g, or c
ctcaagtgatcctccttgccctcagcttcggcctagcgrggatcacakgcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctkgcacctggtgccacgntgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccacactgaaaaaaaaaaaaaaaaaaactcgggggggggcccggtacccatttngccctntagtgggt

SEQ ID NO: 4189 - DNA, 1811 bp, Homo sapiens
  misc_feature (2)..(2): n equals a,t,g, or c
  misc_feature (4)..(4): n equals a,t,g, or c
  misc_feature (16)..(16): n equals a,t,g, or c
  misc_feature (1810)..(1811): n equals a,t,g, or c
cngncagtaccggtcngattcccgggtcgacccacgcgtccgctgcattccagggcctttcagtggctttcattctgaagttcctggataacatgttccatgtcttgatggcccaggttaccastgtcattatcacaacagtgtctgtcctggtctttgacttcaggccctccctggaatttttcttggaagccscatcagtcstyctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaacctaaaaaaaaaann

SEQ ID NO: 4190 - DNA, 1947 bp, Homo sapiens
  misc_feature (480)..(480): n equals a,t,g, or c
ggtcaatttaacttaacaagtatttattgaatatccacatgtaggccagaatcagattagtaaccaggtgccttggaattttaaaatttctcctctctttattaatggatttagcgagtggaaatcaggctttctgtgatggtttataaaggtattttcctggctctcttggagttctctgtccaccttgctgcagtctttgttgtgatggggagaccacatgggagcggtccagatgagtgatgctacgggcccaaactgttagtggccgtgaggatataggttgtaggggacatctggagtggaaagagtgctcttctcacacagctctctctacttactgcccctaggatggtsggtgcaactgtggcaagggcagtcagggtaggggaatcccttagaggaattcagcagtgactagtctggttagcctttcccacaaggcccattgagttatgagccccctcctttggtttgtanaaagagaaggtagcagcctagaacaggtgagaagatgaggtaggtccttctgctcaaacatcctctctccgtattttaccaccacgcccagccaccactacgyactttaaaaccaaaaaaagctcaaagggatggatcattgtccatggctcaggagccccactgtggggtaagtgtgatgtcgatggattaatttagacagtggtgtattcatcagggcaaaggaaattcttccagaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttactaatcacctcttctgtcattccgtccttggccaccgctcagtgggaatggtctctgatctggatgctcccaccttccatgtcaggcccagaactgtgccatggtctgtggactcctggtcagccttgactggctaggagaccttgggcagtacctacagtcttgctgtttctgtttcatctgcaagaattatgacccacacactccagctgcagcccagggcactgtgatattttatacgtgtgtagatgtttttgtccacagttcctggttcatcactcccataaccctttgttataatgttgggacactgcaggcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataaygtttgtaataaactggtaaacataaaaaaaaaaaaaaaaaaactcgta

SEQ ID NO: 4191 - DNA, 764 bp, Homo sapiens
  misc_feature (591)..(591): n equals a,t,g, or c
  misc_feature (599)..(599): n equals a,t,g, or c
  misc_feature (613)..(613): n equals a,t,g, or c
  misc_feature (636)..(636): n equals a,t,g, or c
  misc_feature (658)..(658): n equals a,t,g, or c
  misc_feature (680)..(680): n equals a,t,g, or c
  misc_feature (746)..(746): n equals a,t,g, or c
accggtccggaattcccgggtcgacccacgcgtccgcccacgcgtccgagttctacaggctctggctgtctctcttcctacatgctgggtaagaggctcctcactgcccccgaacccgacccctgtgatggccacccagccggacccctggggaaaggttcctgggccagggcatggccggcccaacctgccgaagcctactgctcctgaagtgcctggctgaaggccgctgcctggtgtgtccctcccccagcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtgggcccggccggctcacagttcggcctyctcgcctgctcttcgtggagctcttccagagctggccgctgctggagaggccctggaaggccttcctcaacctctcggccatcgtgctcttcctggtcatctgtggcctcctgccctggatcgacacatcgcccacatcttcgggcttcctcantggcctgnttgctggccttcgncttcctgccctacatcacctttnggcaccaagcgaccagtaccgnaagcgggcacttaatccccggnggtcacttggctgggcctttggccgggccttctttggcccggcccttcggggcttgggggcttggnacattttaacccccaatt

SEQ ID NO: 4192 - DNA, 1894 bp, Homo sapiens
  misc_feature (1878)..(1878): n equals a,t,g, or c
ctctaatacgactcactatagggaaagctggtacgcctgcaggtaccggtccggaattcccgggtcgacccacgcgtccgggatgacactgggccccccatggacaagtctgatctgggccagaagcggacttcgggggctgtctgccaccaggaccccaggacctgcgaggagccagcctccagcggtgcccacatctggcccgatgacatcactaagtggccgatctgcacagagcaggccaggagcaaccacacaggcttcctgcacgtggactgcgagatcaagggccgcccctgctgcatcggcaccaagggcagctgtgagatcaccacccgggaatactgtgagttcatgcacggctatttccatgaggaagcaacactctgctcccaggtgcactgcttggacaaggtgtgtgggctgctgcccttcctcaaccctgaggtcccagatcagttctacaggctctggctgtctctcttcctacatgctggcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtasggacgatgtctcatggattaaataatattctttatggcagtaaaaaaaaaaaaaaaaaaaaaaaaaaaaaaaaaaaaactcgagggggggcccggwacccaaatcgacnaatagtgagtcataaa

SEQ ID NO: 4193 - DNA, 780 bp, Homo sapiens
  misc_feature (580)..(580): n equals a,t,g, or c
  misc_feature (665)..(665): n equals a,t,g, or c
  misc_feature (683)..(683): n equals a,t,g, or c
  misc_feature (691)..(691): n equals a,t,g, or c
  misc_feature (718)..(718): n equals a,t,g, or c
  misc_feature (740)..(740): n equals a,t,g, or c
gcacccatctgatggtgacggtccgtgttcctaatcccccaccaccaccgtcagcctcccacccctctgtgcgcctcactgtccgtctgtccatccacccccagatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggcaacgtggcctacatcatcatcgagtcccgcgaggaaggcgccagcgactacgtgctgtggaagsasayyttstcctgstggacctcatctgctgtsgtgccatcctgtycccgtagtctgskcccatccggcatctycaggaygcgtytgsccacaagacgggaaggyggccagtgaacctggccaaagcttgaarcttgttcccggsatttactatgtcatgggkcatytgstacgtctactttcacccggatcaatcggccatcctgcttgcanggtggcttggtgccccttttcaagtggcaagtgggcttgtacccaagcttcttgggtgggaagggcttccacccttgggcctttnttcggggcttaccgggcntacaaagnttcaggcccacaggggaacaaacccgnaaccttgaacttgcccaagaanggacaaggagggatggttaaaatggagcaagtaatggacg

SEQ ID NO: 4194 - DNA, 1996 bp, Homo sapiens; identical to SEQ ID NO: 1240
  misc_feature (1975)..(1975): n equals a,t,g, or c
  misc_feature (1980)..(1980): n equals a,t,g, or c

SEQ ID NO: 4195 - DNA, 786 bp, Homo sapiens
  misc_feature (610)..(610): n equals a,t,g, or c
  misc_feature (663)..(663): n equals a,t,g, or c
  misc_feature (698)..(698): n equals a,t,g, or c
  misc_feature (706)..(706): n equals a,t,g, or c
  misc_feature (737)..(737): n equals a,t,g, or c
  misc_feature (740)..(740): n equals a,t,g, or c
  misc_feature (762)..(762): n equals a,t,g, or c
taagctggtacgcctgcaggtaccggtccggaattcccgggtcgacccacgcgtccggaaaatgcattcagaatcttcagagtcaggtgaaaagctttggccatgattggccttggcattggttgtgctggacagcgggaccaggcgcccccttacctggctcccccctcccaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaaggtaggggaagtctggtggtggcggtggggagggagcgaaaaatgtaagagaccagttgggctccaacagaaagaggcatcagggggctgggatgggggtcaatgggggaaggccctggggtcaataggcgggagccttgcagccaactccctggatttcgggggtcaagtgaggccagcatcacttgctccagcagcctaacagccaggacacaggggtccaataagaccagggcccaccccargcctntgacccttacccacagatgarttctgtccagtctggaaaagctatgagatcgnctttcccamccgcgtggaccacaacggggcactgntkgccttnttggcaacttcttcccggaagcagcggccgnggnaccggggggccacaggccaatnccggctttttttacaaaggggctt

SEQ ID NO: 4196 - DNA, 237 bp, Homo sapiens
  misc_feature (89)..(89): n equals a,t,g, or c
acgggggcacacagccgagtgccgctctcttctacaaagtggcctcgcccagcacccacttcctgctgaacctgacccgcagcttccgnctactggcagggcacgtctccgtggagtactggacacgggagggcctggcctggcagagggcggcccggccccactgcctctacgctggtcacctgcagggccaggccagtagctcccatgtggccatcagcacctgtggaggcctgg

SEQ ID NO: 4197 - DNA, 233 bp, Homo sapiens
  misc_feature (2)..(2): n equals a,t,g, or c
  misc_feature (97)..(97): n equals a,t,g, or c
cncatatataattttaaaataaaaagaaattagaggctgagcatgctgactcatgcttttaatcttagccctttgggaggccgaggcaggaggatcncttgaggccaggaattcgagaccagcctgggcaacatagtggaaccccatctctatgaaaaataaattaaaaattttaaaaattaaaaaaaaaaaaaaaaaaaaaaaaaaaaaaaaaaaaaaaaaagggcggccgc

SEQ ID NO: 4198 - DNA, 1848 bp, Homo sapiens
  misc_feature (1796)..(1796): n equals a,t,g, or c
gaacttccggctgtcaagctcccggccgggctgactcaagcggaggcgcgcggaacagtcgccgaggcattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccaygtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaattgttctccactttttgcggagagaggagtttcacaggaactggaaatgtgctttatggcatttgcctatccactctctccaacctgaagacacgttgccaagctcacctacccgaggggcagcccactcccagcccctttgaggcctatacagagctggtggggtcgggggtgccaagccaggccctcccctcccntcggttgttgacacaaagatgaggaagagatggtaggataaaaaaaaaaaaa

SEQ ID NO: 4199 - DNA, 595 bp, Homo sapiens
  misc_feature (551)..(551): n equals a,t,g, or c
  misc_feature (575)..(575): n equals a,t,g, or c
  misc_feature (577)..(577): n equals a,t,g, or c
  misc_feature (587)..(587): n equals a,t,g, or c
ctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgscgggccctgcagcagctgcttttcccaggcaaggccttcagctggccacgacatgtggccatagctctgatcctgcttgntttggtcaatgtccttgcatctgngngccaaccatncgggatat

SEQ ID NO: 4200 - DNA, 923 bp, Homo sapiens; identical to SEQ ID NO: 3622
  misc_feature (9)..(9): n equals a,t,g, or c

SEQ ID NO: 4201 - DNA, 1221 bp, Homo sapiens
  misc_feature (1135)..(1135): n equals a,t,g, or c
  misc_feature (1140)..(1140): n equals a,t,g, or c
  misc_feature (1165)..(1165): n equals a,t,g, or c
  misc_feature (1177)..(1177): n equals a,t,g, or c
  misc_feature (1189)..(1189): n equals a,t,g, or c
  misc_feature (1198)..(1198): n equals a,t,g, or c
  misc_feature (1206)..(1206): n equals a,t,g, or c
tcgacccacgcgtccgggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctycaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgccgcctggccgtgctgctcgcggtgaccctnactgngccagtcgtgctggtccctatccgncgggccctgcancagctgcttttnccaggcaanggctttanctgggcacgacatgg

SEQ ID NO: 4202 - DNA, 1987 bp, Homo sapiens
  misc_feature (442)..(442): n equals a,t,g, or c
  misc_feature (444)..(444): n equals a,t,g, or c
  misc_feature (473)..(473): n equals a,t,g, or c
  misc_feature (493)..(493): n equals a,t,g, or c
  misc_feature (1011)..(1011): n equals a,t,g, or c
  misc_feature (1025)..(1025): n equals a,t,g, or c
  misc_feature (1111)..(1111): n equals a,t,g, or c
  misc_feature (1119)..(1119): n equals a,t,g, or c
  misc_feature (1169)..(1169): n equals a,t,g, or c
  misc_feature (1234)..(1234): n equals a,t,g, or c
ggcacgagaccggcgctagtcttgcgtcgcacagcaggattgcgctgctttctgatgaccttcgacatggatggcgatggtaatgaacgcttttcccgtaacgccccacccgcaaccgacccaggccggaatgaccctgatcgaggtcctggtatctgtgctgatcctcgctgtcggcctgctaagggcggcagtcattcagctcaatgcattgaaatacaccgacagttccaggatgaccagtcaggccagtttcattgcctacgacatgctcgaccggatccgcgccaattcgggtgctgattactcctggggccagggtgaacgcgcgccctccaccacctcggtcgcgagtgtgcgtgatctggacctgcacgactttgaagcgaatatcgtcgggttcgccggggaaagcgccaaggggtccgttgcggtcaatcancnagaagtgaccatcagcatcagttgggacnactcccgtggagcgaatgcncaaggcacccgggaaacattcaccctgaccagccgggttgcagtcgatccgagggtgttgccatgagaggtccagtgtgcggtttcagcctggtggagatgctgctggcattggccctcggcctgatgttgatcctgggggtgacccaaattgcactcagctcccgaaccacttatgccagccagagtgcggcttcgctgttgcaggatgatgcacggttcgcccttggcaagctgattcaggaaatacgccaggcgggcatgtttggctgcttgtccgctgcatcaatcagcaacgctcccgcaggttttgatcgtcccattggatggagtaccaccggcagttcccggtccctgacgctggtgaccgccgacgtcggggagggtggcagcaagccggactggacggtgctttccgattgcaccggctctgcccacgcctatgttggaagcccgccggcagcgaacgcccgggcaaatccacttcccacttgcgcaaagctgacctaacacctttgnagggcgggcaagcnggaagttaagtaacgctggcggcccccgagcaaagcggtggttggtggataacgtggggcattcgatatcagttttcggcgtggcngacaagcntggctcaacggttgtcagccgatatgaccccacccccggcgatgagtcgntcatccgcagcgtgcggattctgctgacacttcaggatccaaatgggttggtgaaagaccaggcntacagcgtggtcgcggcactacgtaatcgcctggagtagcgtgcccatgggttattacctctcccgttcgaggcaggcaggcatggttttgctgatcagcctggtattcctgctgctgttggcactcctcggagtgtcttcgatgcagggagcaatctcgcaagaaaaaattaccggcagccttcggcagcgcaaccagtcgtttcagcaggccgaaagcggcctcaggcttggcgagtctttggtgcaggcgtcaggtttcgccctgcgcccttgccactcgacggctgcgtgcgcgccacctgccgaatcggtttcggtagtggggccggggacgaaccccgtatcgactgtgacctggatagggatgaaagatggcgtctacggtattcaaaacctggggccgggaacgggtttggtcaactcccggcagaggcccaggccacggtctatcgcgtgacatcagtgggcgtcagtgggcactcgcgttcggtcctggagtctgtgtatgcccgtgtgggcagcgggcccggcgagcgtttccgacgaatcatgtggcgacaacttcaataggtgagcagcacgatgggcaaggattgcacaggcttcaccctgatcgaattactgatcgccgtggcctcgtgccgaattcggcacgagattaattcccctaaaaatctttgaaatagggcccgtatttaccctatagcaccccctctaccccctctagagccaaaaaaaaaaaaaaaaaaa

SEQ ID NO: 4203 - DNA, 857 bp, Homo sapiens
  misc_feature (493)..(493): n equals a,t,g, or c
  misc_feature (562)..(562): n equals a,t,g, or c
gaattcggcacgaggggaaataatgtttgtggaaaattgcttagaggaaatggagtatattactggtataggtactctaaaatgtcttttgaattaagtcagagttagagggttgtgtctctaaaccgcatcttactggtattatgctatcagcctgtattgagagactttataggtaaagtccaatttaggctgtttggtattatctattaaaattagaatgttcatgctctgtaacctgctacttccacttctagaatttatctttggaagcacatatctgtccacagacctatatttacacacatgtatgaagaatgtkttccttcacattcattcattttaacaaatgttttgatgtgtagggcctaagctgatttgaatgcagctgaaatgcacatatctggttgagtcmtgggaactgatttgcatgtgtctttctcttttatggcttgaagaggagagaaatttgtgcttagcacattgaagggcntacgagatacaaggagtctgtccttagctctgccctttggactgttgtctgaaggctaaagaagagagnacaaagaaagcttgcattgggaggctgaggtgggaggatcacttgagcttaggagtttgagaccagcctgggcaacatagggagactgcacctctataagaaattttaaaaattagccgggttggcagcgtgctcttgtggtcccagccgcttgaaaagctgaggtgggagaatcgcgtgagcctgggaggtcgaggctgcagtgcaccgtgattatgccactgcactccagcttggcaacattgactgtctcaaaaagattatatatctctaaaaaaaaaaaaaaaaaactcga

SEQ ID NO: 4204 - DNA, 325 bp, Homo sapiens
aattcggcacgagaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaacttcaaaaaaaaaaaaaaaaaaaaaaaa

SEQ ID NO: 4205 - DNA, 858 bp, Homo sapiens
agaaaaaatcctacatggatattggtaggaaagagagaaaggaagtggccagtgtcccgtggcctcttccaccttctggattgttgaagctggggcctggaggggatggtcctgccactcagcagggggcactaatgggaccaagctaacctgtccagtgagaatcctgcagggagacctgagggtaccaggaaagtgcaggggaaggcccgggaaatggagagagctggtctggaggggaggagcaagccgcgtggggcaggccatgtgccttttgcctgggggagtattactcatttggagctgtgcgtctggaacgcctgcctcacacacaaaggactggggcagatgtaagttctctgcagcaacgaagcgcacagctgagagtaacttagaaagcacccagctaatgctggcatcccagatcgaccccctcctcgctgaatgttggcatctctgtgcctcagtttcctcatctgtaaatgggggtgataagaaatgtgtacacacctcccgggcagtggggaggattaaactgtgctctgacacgatccgggcatgttcagggtggtatctgcagtaaaccgcgctcggaaaatggcggcgcatcagggccagcggtgggagctctccgtgcttggcttgacgccattgtggaggtggaggaggggctgcaagactctgagcaggaagaccccgcaaagcaggaaagcagagccagagttgggggccagccgcagaaacgagagcccccgtgactttgaggcaccctttggagagggcaggaagcaggaagggtaaattttctccaaaacccaagaggcagagtgaccccacatgataactgagtttctcgag

SEQ ID NO: 4206 - DNA, 344 bp, Homo sapiens
  misc_feature (266)..(266): n equals a,t,g, or c
  misc_feature (292)..(292): n equals a,t,g, or c
  misc_feature (306)..(306): n equals a,t,g, or c
ggcacagaaaaatttctagcctcactagtatcagagaaatgcaaattgaaacaaggtgccatttttggactctagttagtgatggtagtgaaaaccagaatggtcctttctaaaacagcctgtgtgtcaaaaccataaaaatgcttctacctctttttaccctgttaattctacttctgagagtttttcctaaagaaataattcaaaataggraaaagctaaaagcagaaaaatgttggaacatgacattatttatagctgtgggnaagatgggaggctggggcacatgggntatgctggaaatcncagcactttgtgaaggcccagttggggaggatgccttg

SEQ ID NO: 4207 - DNA, 312 bp, Homo sapiens
  misc_feature (273)..(273): n equals a,t,g, or c
  misc_feature (312)..(312): n equals a,t,g, or c
cggggggatgtgctgcaaggcgattaagttgggtaacgccagggttttcccagtcacgacgttgtaaaacgacggccagtgaattgtaatacgactcactatagggcgaattgggtwcacttacctggtaccccacccgggtggaaaatcgatgggcccgcggccgctctagaagtactctcgagttttttttttttttttttaagagatggggtctcactacgtttcccaggctggtctcaagctckggggttcaagcaatcctcccaactnggcctcacaaagtgctgagattacaagcataagccactn

SEQ ID NO: 4208 - DNA, 390 bp, Homo sapiens
ggcacgagcgtcttgcccttctcccgattttctgcccccactttctaaagcatgaaactctttatgtaagccccctgctcaccatcctgcgtggagttcccgcctcaaggccctgcccctgggcctgacactcggagcccttcccagtctaccctcatccttcccctgcccacaggccctcacatcttatctggtcatggaattatctggcattctctggcaattttcagccacctccttccccagctcccaggcctcttggccctgacatctttttataaaccaggacagtgtttaggaattaatgagaacccagacctcagacctggatcctgagcagcagagcagtggatgcccagggctctcgcttaaaaaaaaaaaaaaaaaaaa

SEQ ID NO: 4209 - DNA, 707 bp, Homo sapiens
tcgacactagtggatccaaagaattcggcacgagcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaaaaaaaaaaaaaaa

SEQ ID NO: 4210 - DNA, 2346 bp, Homo sapiens
gcccacgcgtccgcccacgcgtccggtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaaaaaaaaaaaaaaaaaaaaaaaaaaaaaaaagggcggccgc

SEQ ID NO: 4211 - DNA, 2338 bp, Homo sapiens
  misc_feature (2335)..(2335): n equals a,t,g, or c
gcccacgcgtccgcccacgcgtccggtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaaaaaaaaaaaagggsggccggtmcccattcgccccatagngag

SEQ ID NO: 4212 - DNA, 603 bp, Homo sapiens
ggcacgagcaaggacagcacaatgccatggcaaccgcttccatcaataacttaatttcatctctgctcttacatctttctctcctcagttctaaagctggaaaatttttaatttggaaagaacataagacggcttgtggttgctatgccaacagcacctgcctgcttcctaatgggctttccaatcataaaggaaagtcttagcaagtcacagaactttagactccaggggctctggagggcactccgcacagcacggcctctcacttggccgaggagaccactggcacccaggaggttaagttccctgtctgtccacagcaattctactagcccgcgctgaagttacaccaaggcaagcagcttaattttggccaacccgaaggatttaggcaggatttgggtggaaggcagctgggcgacccttgaggagagttgctgtaagtatctttctacccccaaaatccagtatatttagtcagcttgggctgctgtaacaaagtaccacagactgggsggcttgaaaccagaaggtggaggtttcagtgagccgaggttgcgccatgcactcarcctgggtgacagagcggactccgtctcaaaa

SEQ ID NO: 4213 - DNA, 1016 bp, Homo sapiens
  misc_feature (18)..(18): n equals a,t,g, or c
acagagcgagactccgtntcaaaaaaaaaaagaacgtgctgtcatcaaaataggcaccacctgagatcagagaacacagagtttcccctggcaaaaggagctccaaagggaagacagacacacccagccacccaggctggccatatctgggcactggaggaagtgtcccggcagcaagggctctggwgactgctctgtgaggattcctcgtggctgagacgttggcccggccccaccttggcacaatctagttggagcatccactagatgctcccatgagctgtgcagcccaaggttgaggtcagagatagcaaggccacctgggtgacagcatggtctgctgcatgccacgcccctcccctctttgtctttgctttgtgctttcttttcctaggaggtggcaggtgtacatttctggctctgagcccatgtcagacccccaaaggagcccccactgtcctgatcccctgcacggcaccccaccacaagcagcaggcacacgtggtgggaatcaggtaacgcagttcccccgggaagccccttccatggaagaccactcctgctgctgcagcctgctggtcctgtgccctttcaggatcagcccttcgaccccagccaagggccctggccaggcctccactgccggccccaaggcttaatgcacagcatgtgcctgccagatctgactccagaggatggaggaaaggcccaagaccacacagccctgggccacagcagagagcaggacactcctggtgtgcaggagaatttccaaggtgcagcacctcttgacagatacaccaggaggtttaatactttgtattaccttggtaaccagagaagaggaatcattaaaactcgaaaatagtgctgtgtgctgtgcagtggctcacacctgtaatccctgtgctttgacaggccaaggtaagaggatctcttgaaactaggtgttcagagccagcctggacaacacaggttgtatttacctctacaaaaaaaaaaaaaaaaaactcgag

SEQ ID NO: 4214 - DNA, 712 bp, Homo sapiens
  misc_feature (660)..(660): n equals a,t,g, or c
  misc_feature (668)..(668): n equals a,t,g, or c
  misc_feature (698)..(698): n equals a,t,g, or c
gttcaccatgttggccaggatggtctcaacctcctgacctcgtgatcctccctcctaggcctcccaaagtgctgggattacaggtgtgagccaccgcatctggctaccttacattttaaaataacccttatcactactgaaaatgatgtctttatatgtctatctccttatgttctgtttccttactctcctcccaggaacataaacttcatgagggcaaggactttgcctccttcacttttgtgtctctggtgcttagctccgtatttgaatatttgttggatgaatggataatgactattccaggactcgcttgatacagaactatcttctctagagaatggaaaggtaaacgtatcatttaccagccacttatcttaagtagagtcccagagtgtaggcttatgccatggagctcatgtgaatttccacttgggccatctgggattcttttctcaaaagagcctgatgccgggtgcacgggccggtcagctggcctggagggatataacccacatttacctttctcctcctggcagtattctagaatacctcactcactgcagcaagggagcttctctcctgggtcgggtagggggatatgggttgaatgtagccctgaaggagcgtctcaaatgacctttgggcccagttggtctngtgtcagnctcctgggggagaaggatcatttagctcangtggaaaaacgaat

SEQ ID NO: 4215 - DNA, 1082 bp, Homo sapiens
  misc_feature (909)..(909): n equals a,t,g, or c
  misc_feature (943)..(943): n equals a,t,g, or c
  misc_feature (966)..(966): n equals a,t,g, or c
  misc_feature (1035)..(1035): n equals a,t,g, or c
  misc_feature (1040)..(1040): n equals a,t,g, or c
  misc_feature (1055)..(1055): n equals a,t,g, or c
gcaaactcattgaaaacctctgctcgggtgacatcctttaatatttcattggcaagacccagcgcagtggctcacacctgtaatcccagcactttggtggsccgaggagggcggatcacctgaggtcaggagttcaagaccagcctagacaacatggcgaaaactcatctgtactaaaaaatacaaaaattagctgggcttggtggtggscgcctgtaatctcagctacttgggatgctgaggcaggagaattgcttgaacccaggagtcagaggttgcagtgagcccagatcattccactgtactctagcctgggtgacaaagtgagactttgccaaaaaaaaaaaaaaaaaaaaaattccattggcaaacaaatcacatagtcaagactagcatcagtgggttatgaaaatgtgctctgtggactctagtgggggaccctgcaaagtctggggcaaaggctgtggatgctgaattctgttacagggagggagtgaaaaattgagagtagtaatccagtctcccacggggcccatcacggctgtttggaggcacacatgagttaccatggcgacatcttgaatgagaagggagaaactcaatggtaagggcaagaagcagaagattgttcctttgttcctattactttgatacatattccttgatttgcaccttccaggctaaaattttgagcctccttgatttttaccttcaggctaaatttgagcctttggaagctcaaattacaggaccatgaacatctctccctggcaggaagcaacaaggctgagaactcgagagtacttctagagcggccgcgggcccatcgattttccacccgggtggggtaccaggtaagtgtacccaattcgcctatagtgagtcgtattacaattcactggccgtcgntttacaacgtccgtgactgggaaaaccctggcgntacccacttaatcgccttgcagnacatccccctttcgccagctggcgtaataagcgaaaaggcccgcaccgatcgcccttccaacaagttgngcaancctgaatggccaaanggagatccaatttttaaaggggattaa

SEQ ID NO: 4216 - DNA, 770 bp, Homo sapiens
aattcggcacgagccgaggggcgaatccatacatccgtcgtgtggactcgccctgacatcccctcaacgcttagactcggcattcttttcattgcctgatgccgtttcatgccttctttgcgtttcctcgctctggccctcctgctggccatccttcccgcacttcccaacgcccatgccgcgccggggattggcggcctgatcggcggcggctcccaggcctcagccaaggaagagccccagagcaacgcgcaacccagcgccgatgagcgcaaacaacgactgctcagccaggccgaggaaacccggcagcgcctgaccgatctcaaggccgaactcgccggcgcacccaaggagatcagcgaggcccagcgtacgctctccaaactggtgagcgaggacaacagcgatctgcccgagcgcctctccaagctttcggtgccggtactggagcaacgcctggcggcccgcgtggacgagctcgccctctggcaacaagcgctcagcgcggccaacagcatgctcatcagcgcgcagacccggcccgagcgcgcccaggccgatatcagcaagaaccagttgcgcatcgacgagatcaacggcctgctgaaaagcggtcgggagaacaacaagccgctgacggacgaacgtcgcgcgctgctcgagagtacttctagagcggccgcgggcccatcgattttccacccgggtggggtaccaggtaagtgtacccaattcgccctatagtgagtcgtattacaattcactgg

SEQ ID NO: 4217 - DNA, 543 bp, Homo sapiens
  misc_feature (22)..(22): n equals a,t,g, or c
  misc_feature (42)..(42): n equals a,t,g, or c
  misc_feature (51)..(51): n equals a,t,g, or c
cgtcgcccgcttggagggtcgncactagtggatccaaaggantcggcacgngctaccccttgccmaagcctaaacttcatactagatatccaactgcctactggacatctccatttataagcctagtagcctaataagcataacctcagacttaccaggcctcacactgaagtcatgaacttcagcccaacccccatgccagggcaaaaccttgttgttacctcttattcctctcttgcctcatcccatccatgttcagtctgtcagtggatcctgtgagtccagtcttgaggatagttccaggatctgatcacttctcactgcctcttttgctgccaccacctctggcctggataattgcagcagcctcccagttagccttgctgtgtccatccttgttttccccttctgtctgctctcaacagaggagctagtgattctcttaggacagaataaatcatttaggttttcttcacatggtcctgaagaagcttcctacctcactcagtgtaaaaaccaaaaaaaaaaaaaaaaaaaactcga

SEQ ID NO: 4218 - DNA, 1475 bp, Homo sapiens
tgacttggcgcagcacccggcgggcggactgcttgccgatgcgtaccagaccgatggcatggccagcgtgcagggcgatcccggcgatgcggcgcaatatcccgaaggggagtttgcggatgaagacttggtctcgctgcctctgctgggccgcgcaaccactgccgtccaccagcgccgcctgctgatgctgctgggtgttggcttggtggtgctcgccttgattgccggctgggttctgcagcaagccaaccgctcggcgcagcagctgacggcgaccggccagtcgctgatgcagtcgcagcggcttgcaaagtccgtgtcgcaggccttggtgggcagcccccaggccttccccgacgtggtggagagctcgggcgtgctggcgcgcaacgtgcgcgcactcaacggcggcgacaacgaactggatgtgcaggcactgggcgagcctttccgccccgaactggatgccatcacgccgctggtggagcgtgccgagcgcaacgcgggcgtggtgatggggcagcaaaagatcctgacgcaggtgggcgacgctctgcggaccatcaaccgccagtcctcggacctgctggagatcgcggagacggtctcgtccctgaaacttcagcaaaatgcgcccgcctccgagatttctgccgcaggccagctcgtgatgttgacccagcgtatcggcaagtcggctaacgaattccaaacgacggagggcgtgagccccgaggcggtgttcctgctgggcaaggacttgaactccttcaaggaaatcgcacggggcatgctggacggtagcgccgacctccgcctggctgccacccgcgatgcccaaacccgcgagcaactggagtcgctcatcaagctgtatgagcagacgcgtacgcaagccggcgccatcctgggcaacctccagggtctggtgtccgcacgtgaggcgcaatcggccatcctggcagacagcgaaccgctgcgccgtcaactggaaggcctgcaaagcaagctgtcggcacaatcgggcatgggtgcggccagttcgctgcgctcgccgtcgccggtatcttcgtcttgctgtgcggcgtgggtatttcgcgcgtgcagctgctggacagccgcagccgccaagccacggccgaagcacagcagcgtgatgccaagcgccaggaacaggaagccaagcgcatcaacgacgccaaccaggcggccattctgcgactgatgaacgaactgcaatcggtcgctgaaggggacctgacgcaggaagccaccgtgacggaggacatcacgggcgccatcgccgactcggtgaactacacggtggaagagtccgccagctggtgggcaacgtgcagaacaccgcggcccggatggcccagaccaccgcgcaggtggacagcacctctacggaactgctggcggcttcgaccgagcagctgcgtgaaatccgtgaaacgggccgttcggtg

SEQ ID NO: 4219 - DNA, 704 bp, Homo sapiens
  misc_feature (2)..(2): n equals a,t,g, or c
  misc_feature (499)..(499): n equals a,t,g, or c
  misc_feature (567)..(567): n equals a,t,g, or c
  misc_feature (634)..(634): n equals a,t,g, or c
  misc_feature (692)..(692): n equals a,t,g, or c
anaaaattttctccttaagttaacaaaacctgccgctcgcgcgcctgcaggtcgacactagtggatccaaagaattcggcacagactgacttggcgcagcacccggcgggcggactgcttgccgatgcgtaccagaccgatggcatggccagctgcagggcgatcccggcgatgcggcgcaatatcccgaaggagtttgcggatgaagacttggtctcgctgcctctgctgggccgcgcaaccactgccgtccaccagcgccgcctgctgatgctgctgggtgttggcttggtggtgctcgccttgattgccggctgggttctgcagcaagccaaccgctcggcgcagcagctgacggcgaccggccagtcgctgatgcagtcgcagcggcttgcaaagtccgtgtcgcaggccttggtgggcagcccccaggccttccccgacgtggtggagagctcgggcgtgctggcgcgcaacgtgcgcgcactcaacggcggcnacaacgaactggatgtgcaggcactgggcgagcctttccgccccgaactggatgccatcacgccgctngtggagcgtgccgagcgcaacgcgggcgtggtgatggggcagcaaaagatcctgacgcaagtgggcnacgctctgcggaccatcaaaccgccagtcctcggaccttgctggagatcgcggagacngtcttcgtccct

SEQ ID NO: 4220 - DNA, 565 bp, Homo sapiens
  misc_feature (35)..(35): n equals a,t,g, or c
  misc_feature (50)..(50): n equals a,t,g, or c
  misc_feature (86)..(86): n equals a,t,g, or c
caacttccagggtctggtgtccgcacgtgaggcgnaatcggccatcctgncagacagccgaaccgtgcgccgtcaactggaaggcntgcaaagcaactgtcggcacaatcgggcatgggtgcgggccagctattgcgctcgccgtcgccggtatcttcgtcttgctgtgcggcgtgggtatttcgcgcgtgcagctgctggacagccgcagccgcmaagccacggccgaagcacagcagcgtgatgccaagcgccaggaacaggaagccaagcgcatcaacgacgccaaccaggcggccattctgcgactgatgaacgaactgcaatcggtcgctgaaggggacctgacgcaggaagccaccgtgacggaggacatcacgggcgccatcgccgactcggtgaactacacggtggaagagtccgccagctggtgggcaacgtgcagaacaccgcggcccggatggcccagaccaccgcgcaggtggacagcacctctacggaactgctggcggcttcgaccgagcagctgcgtgaaatccgtgaaacgggccgttcggtgctcgag

SEQ ID NO: 4221 - DNA, 413 bp, Homo sapiens
  misc_feature (315)..(315): n equals a,t,g, or c
  misc_feature (377)..(377): n equals a,t,g, or c
  misc_feature (410)..(410): n equals a,t,g, or c
  misc_feature (413)..(413): n equals a,t,g, or c
actccactctttggaagattctcttctgtaaacagaggccgttatgaatgaaaagttccttcccccactttgattgatcctggatgtgaatccatctgcccactgcagctcgtcaggagggaaggaacgaggctcccagagcagaggccctcgatgcttctgttgcgctgtgcccctagcctggggacccatttgtttcttaacatgctgaggccaccagatgggccctcatggctgcctcttctcacccccctcccacttttggtccctgggtttcctaggccctggcttgccccaccccgaacaggcattganccccttgggaacagggcccccacccatggctgggttctcttgcttccctccatccttccgantttgaaaattggtgaaacctccctttggaggtntgn

SEQ ID NO: 4222 - DNA, 691 bp, Homo sapiens
  misc_feature (88)..(88): n equals a,t,g, or c
  misc_feature (132)..(132): n equals a,t,g, or c
  misc_feature (666)..(666): n equals a,t,g, or c
  misc_feature (677)..(677): n equals a,t,g, or c
gtgggggacggcgtctcactgtgttgcccaggctggagtgcagtggcacgattctcctgtctcagcctcccaagtagctgggattacnggcgcacatcaccatgcctggctaattttttatgcytttggtanagaggggtttttgccatgttggccaggctggtctggaactcctgacctcaagtgatccgcccacctcagtctcccaaaatgctgggattacgggcatgaaccaccatgcccatcctagagtgtccatttaaatcatggttcctgttactgttactgagaagaatgtaagtctccccacctrcagggcagatgctgagcaggagaatcactaccccacccaggccggcactgcccagccaaggctcccaggcctggaggacacagcctgcctaactccccaccccccaccctctttctcagctttttctccaagcagggcccccgaggaggggaagacagagctggctcccctgcttctcccccagagtgaacctctgtttcccccaagtgaggtggggatggttagcagccatacctgcctcactcccagaccgtggtggcactgtggatggcatgaagtgggcaccacagtgcatggggttggcagttatatttttttaaggamcaaccctctctgggcctcagtttccccanttgaaaaatcngaggactggcctat

SEQ ID NO: 4223 - DNA, 1691 bp, Homo sapiens
  misc_feature (167)..(167): n equals a,t,g, or c
  misc_feature (1631)..(1631): n equals a,t,g, or c
  misc_feature (1653)..(1653): n equals a,t,g, or c
  misc_feature (1660)..(1660): n equals a,t,g, or c
aaccaaaaagcttggaagcttcggggcggccttgcaaggttcgaccactaagtggattccaaagaatttcgggcacgaaggttgatggaccgccacggcttacaaggccgggatcctgctgggcctgtgcctgtatgcggcgggcgcgctgctgttcatgccggcgncggcarcggcgagctttccgtttttcctgttcgcgctgtttgtcatcgcctgcggcctgggctgcctggagaccgctgccaacccctatgccacggtgctgggggaaccccagggcgccgagcggcggttgaacctggcgcaatcattcaatggccttggccagttcttcggcccgctgattggcggcgcgatgttcttcagcgccggcagcacaccggcctcggacatgagttcgttgcagaccacctacgtggtgatcgcrgttctggtactgctggtggcgctgctgatcgcccgcacgccgctgccggatttgcgcgcccaggaacaggcactgcaaccgacggccggcaaaggtctgtggcagcaccgggagtttgtcggtggsgtgatcacgcagtttttctatgtggcggcccaggtcggagtcggcgcatttttcatcaactacgtcaccgagcattgggcacagatgggcaatcagcaagccgcctatctgctgtcgatcgcaatgctggccttcatgttcgggcgctttttcagtacctggctgatgggccgggtcagcgcgcagaagctgctgctgatttatgcgctgatcaatatcgcgttgtgcggcctggtggtgatcggcctggaaggtatctcagtgatcgcgctgatcgcagtgttcttcttcatgtcgatcatgttcccgacgctgttcgccatgggcgtgaagaacctcgggccgcacaccaagcgcggcagttcgttcatgatcatggcgatcgtcggcggcgccctgatgccctacttgatgggcaaggtggcggacaacagcacggtggcgctggcttacctgttgcctatggggtgtttcgtgattgtggcggtgtatgcccgtagtcgcttgcgccatccgtgaagtaccgscccggcgtcgtcccgaacgtacgccggaacatcgcaatwawggcactgacgttttcataacccaggtccagcgcaacccgggtcacgggtgcatgcgccgccagcaactccagggcgcgcaacaatcgcgcgcgctggcgccactggctgaaggtgaacccggtctcggcaacaaaccgccgggccagggtgcgcggcgagacaccggcccactgcgcccagtgttccagcaggcggttgtcgtcgggactgtcggccagcgcctgggcgatgcgcaacaggcgcgggtyccggggcagcggcaagccgaatggttcctggggcaacccggcgatttcatcaaggatcatctgggcgawccgtgactgtggcggctcgagagtacttctagagcggccgcgggcccatcgattttcacccgggtggggtaccaggtaaagtgtacccaattcggcctatagtgagtcgtattacaattcactggccgtcggtttacaacgtcgtgactgggaaaacctggcggtacccaacttaatcggcttgcaagnacatttcccccctttgcagtgngaatacnaaggccgacgatcgcctttcaaagttggcaa

SEQ ID NO: 4224 - DNA, 897 bp, Homo sapiens
gagtgaggcatagcggtttagataggaaattttaagaatgacaaattaaagaatcctggaaaatacactgtacattctgccaaggtttgtcaatatggatgctggtatagtaatgagaataaatcggtaaattcttttcataaaatgaaggaaagaaattactatgtgctctttaaaatgtgttgcatcagtgcctgatttgattgtaagggtcacatcttcaagacatgtgataccaccctttataccacattatagcattgtctaatgttgtaaagtttataaattgctttcactcagtcttcatctgattctcagaatgaccctatccaattgggaatatgggtttcattagtcttacattactaaggagattcagagagtctcaattggccaacatcatgcagttaaaaatgacaaatggggattttgaacccaagtcttcctgaccccagaacccgtgatctttgtactacatcatgcttcctgagaaattaaatggacctgtcttgcagaactgttcttcttctaactagggatctggaggagtctcaagtaaataggsagatggccttagggagggatgtctggaagsacctgtttggagtcccagcaggttggtggttttctgtctgtaggtctggcagctgggcatggtaacttagccatggaaaggggctgcargaggaggtcctcagtgctcagacccagggcagaggactgtgtggcyccygtttgtttcyccagatctaytctctacacgccttcaccctgctctctgtttgggatggaatcaaaggacccctttgccccctggcttatggttgccttttgccaatggaagcagtgacagaggatcagattagaggtagaaggggagtgaggaaggagagtgaa

SEQ ID NO: 4225 - DNA, 755 bp, Homo sapiens
aaaacccctgttgagacacagcagagttggccagcattcttatggtacttcggatgtggaycctgtgatggctacagcataaaacactgcattagcctccatcttctatccttttycccttcaaaaatgatgatcatttcattgagtgcccaccctgcaccaggtgcttctgatactttatgaaatatgatgttttaaatatgaaaatgggggcttacataatgctgtgactaatttgagccttgctcagcagttaggcagcttcaatcttcttattaatatacagggagtggttgctgataataggcacattttcaagcccaaaggcatcttgacagtgcatgctgaggattgggggaaataggaaacctccaaggaatactcctgatatctttgcatctgtatacacatatgagttgtcttagtgtttttaccatagaagatccttaaaagttgacacaggcaggctctgggtatgtgcatcgagagatatttcccagagtctgtttttttgacatcctttcaccatcattttatctcttagcaggaatcagttgcccaacaactcctgtgatcatctgcaaacctctttacagttttcagtgtctcaaggtaatacataaagaaggaagaaacaaaagagtatgagtatcactattcatggatactaattaccaaatgtacttttttgaattaaatccttgtttgaatggaggttgcacagagatgaatgttttgttagcagacttctcgag

SEQ ID NO: 4226 - DNA, 619 bp, Homo sapiens
ccagccccaacttccttggcccttggcaggccacttgcccacccaccaacccatctgcctctgggcccccartgaartcaraaaragcagrasccccgcaggctgtgagcctggcgcaggtcggctgacagcgagcttctcatctgcctggtggtagagcggacgctctcggcarcctgcacggcccggctcagggccttgttgagctcctctaggtcgcccaggtcgagctggatggagtgccgktgtctccgggctggtgggggagaggctgtgggcggccacttggcagctggttgggctgaggtaggtcctgcaggcgcatagtacacagcggcaggtggataaggcatgatgggaaccgaggagatgtaggcaaaggctggaggggctggtgctgggggcgctgttgccagataccacagtccggggggtgggcgtggcgacgaccccgcctgcttgctcctctgcttggggctgggagttgaaggtgcttttctcctcgtggtggccttctctgccccagaggtggctgagcctggaccatctgcctctgggggagacccaacttgaccacacaggggacactgaagggtatcagcgggaggcggtcccagtc

SEQ ID NO: 4227 - DNA, 899 bp, Homo sapiens
  misc_feature (894)..(894): n equals a,t,g, or c
acccacgcgtccggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcatttatcagtggccagctacctgccaggcccgggctggggcacggtctgcgccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaaatacccaaaaaaaaaaaaaaanaaaaa

SEQ ID NO: 4228 - DNA, 636 bp, Homo sapiens
  misc_feature (122)..(122): n equals a,t,g, or c
  misc_feature (581)..(581): n equals a,t,g, or c
  misc_feature (588)..(588): n equals a,t,g, or c
  misc_feature (601)..(601): n equals a,t,g, or c
  misc_feature (628)..(628): n equals a,t,g, or c
acactagtggatccaaagaattcggcacgagctggtggcatggacattcaaggtaaagctctctatattagatttcttctcaccctttgtcagatggtagtaagtgttatggggaaacgaangcaggggaggagggggctgggtggagcagctgctgtggggagagagatctgcaggaggtggggatgctgtgtgacttgagagagtagcttgccctctctgggctcctgcctgtgtgtgctgggggaacgatggcgcccactgcccctggtgctgtctttgccacatcattccttggggacttctgcccaccagctgctcagaccgtagctgtgctggctatgctcttcctgtgcaggtattgactctgagtcctcatacagcctgttatgatgcgcattttacagatcagtagactgagacctgggcaggccctctgactacagactgagctcattactgcacacagcgtgctgccagtacatgctgggctctggggtgctggagccgcagtcctggccccatcaatacaatccaaagtgagctgggtctgratgargaarargcccaagatgccccantcagggnagtcttcctgggngaggtggtagccaggcagaccttgggnagtaagaa

SEQ ID NO: 4229 - DNA, 898 bp, Homo sapiens
  misc_feature (884)..(884): n equals a,t,g, or c
ggcgggctttgtagacaccacacttggtgggacagaggcctgctagggagagggcctgtgtccttgccaccagcccatcttccacgccatgtccccctgcactctttgaagggagatggtctcttttggggctaagctggggtcctggagccagaagwgaactgagatttgctgtggggggttgggagctgttccatttttagtggctgctacaggaagagcggccgagtgtttccccttgtccctgcagaaggctggagtgtaactgtccttgggaactgggtcagctgatagcagggctgggggtgggggtggggatcctgaatcctycagcagatgtcctcattgccctgatctgggtggccagtgcctgtgctggacacggtcctcagtcatcggagcccactgagtctccccctgaccctgcagagaatttcaaagaggcgaagttccttccagtggcctcacaaaggctatctggcttaggagccattacctgaagccagaatttctgagttccaagtcccagctccatcacggaacttggcccaaggccmttaacccctctgggcctcagttttgwcatctttgaaatggggatcttakagatgcctacctgtcaagggacttgtgaggcgcaacgggaccacacgcagggcctggccagagtgccgtagtttcttcggttgccatgatgggacggtgaaactcctcacactcttctttctgccttgaagattctagacctggctgggtgttcatctccctttttgcctttgcttgargcagtttatggcatggctgtgttattcacgtmccaggtctcctcctggtggacgttgaggccattttcatttttttactcttaaaaacgacagggcagngcacatcttcgcat

SEQ ID NO: 4230 - DNA, 449 bp, Homo sapiens
  misc_feature (37)..(37): n equals a,t,g, or c
  misc_feature (102)..(102): n equals a,t,g, or c
tgtttttaaaaccatcagatytcgtgagattattctntatcacgagaatagcacgggaaagacccacccccatgattcattgatctcccactgggtccctgntacaacacaagggaattatgggagctacaagatgagatttgggtggggacacagagccagaccatatcagcctcccaagtagctggarctacaggtgtgcgccaacatgcctggctaattttttaaatttctgtagagacggggtctcactgtgtcacccaggccggtcttgaactcctgggctcaagtgatccaccctcctcggcgtcccacagtgctggataataggcgtgagccactgtgcccagccatttcccccttatttttagcatcactacagtagctgtgatctctgagctttggggatatcccctccccaacattttactctgaaaatgcgaacatct

SEQ ID NO: 4231 - DNA, 2439 bp, Homo sapiens
ggcacgagggagttttgacagcagagagcagatgctagtggtttcctagagaggggttttgagggaagtgttgctgggagtcatgaacagacctgtctggcggcttttctcaaggacacctcagcaaagaactagcatttcagcctctctggggagactggattgcagtttccattccacagaatcagtgtggttcagctgggctcggtgggaggggctggtggtgggaatctgccaggcagtgccagtcccatcccatgacctcccaatagatgcgccacatgaggcaggtggcaccagcacgacgcgcgcagctcgaacactctgggcttcatgcctcgctctgcctcctctctctgctgtccttgctacctacacttgaggccaacatgtcagggtttcaccaggcccctctgaccctgctcccctcctgcacccagggagatggggaagccaggggccaccacacgcagccaagtttctggagaacagagatgaagtgtcccgtggaggctttgctggagcatctggccacaagggcagtggtgggcaggaacggagaccatggagcccagcaagagcacaggacagcttcagagggccaacagcagcctctggctgagtcctctccttggtggcagccaccccatgggtgaccaccagttccttcccgggtgctgggagttcccaccctgccctgtgggccttctctgggtcccatgatgcactcccccaacccgctgggcaggcttcagtatgaggaggctctggtactcagtaaacgtctgtgagctaacacacctccagctgagaaaggagtccataggaagtagccctcatgggtcagaaaggacttaggggactcaggaagatggaagaaaacccctccgaggttgcggcacaccagaccgctatggttttctgcctcctggactcttactggcctgtattttatcacaggcgagatcacattgcacattcagttttgaatctagctattttcacccaacctaatctcataagcattttcctgtgtgctctaaatgctcataagcttcattttaaatgtctccattatgtccactccctcacttggacctaggccaaaggcacctctgtttgaagcatccaatgaaggcccttcagagcccaggccaggtcttgcccaaggtgggggagcggcggcacacaggggccagctctccaggctgcagatgcctgcctggtggctcctgctctcccgcactcactggtgaccaggacaacatctcttgcacctcagctttctcatctacaaagcagagccaggattagagttgaagctgaaagaagggggaccctgttgccaggctgctccagctcccctcagcagcatcagagccctgagccctgaaccaccagccaaaacttgtcacccaagggctttgctgctggggtgatgggacatccagggggtcctgagacaagggggtcctttgggttcttgcatgcctgacacccaacatcaggagtgggcgtggctggtggggcatcactgggtgccctgaagctgggctcttggttctggcccctggtgtggcccccagggcaggggaacggctgagctgttgggatggagcagaaaccaaaggccaaaggtttttataactcattcaaggtcaccaagcaagccagaacagagccagcacaagaccctggggctgggaagtctgggcctgcactccctgcctcccacctagagcagaggcagcagcctgtgtcaccccaaaccaggccccaggccccagcagtggtcccatctctgggtgacttcttgcccacagcaaggtgcccttggccctacccacacatggctgacctccacgccaggactgtccaggctcggctctttctaggccccgtagaccccatcagcctccaccagcatttgttgacccagcctaaggacaggtggtctgcacacccagggccattgctaatcaggccacctcccccaaggccttccaccttccagacccaacttaggctttattccaccacctggccctccatccgggcttcctaggctctggccagtcctgctcctccctccagagccatgaccagtcgccggcccaggacagaccgggtgcaactgaggaccctcccggtggtcacctgatcgtactgggggtatcagccggacaccccgcctccagaacccgctgcctctgtccagagcggcccagccccagcaggctggcagctcggtgcaaacaacgggatgcagcgggcgggatgcgagccccacgatccctgggtcggaagccaagggcttaagcccccacgttctttctggctcgcggcggacttcgtgcgccccaccttccccgcagttctgagagaggcggtagcagggttcagatggagggaaggacagggcgcggaaaggggagggga

SEQ ID NO: 4232 - DNA, 1674 bp, Homo sapiens
  misc_feature (47)..(47): n equals a,t,g, or c
  misc_feature (1210)..(1210): n equals a,t,g, or c
ggcacgagtgaaaggtatagaatctgggaaagggtggggtgcaagcnaaccaaatagggatgctagggttgggtggggaattaaggactcttctgtgcttttattgtagggctggggatcgaggatctggggcaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggcttyctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgytttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttncagatwatycagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttacaatctataggtacctttgaaaggtcataaagggtaaaagtctatagt

SEQ ID NO: 4233 - DNA, 610 bp, Homo sapiens
  misc_feature (587)..(587): n equals a,t,g, or c
ggcacaggtaatccagcgggaactaatcatgttggtgataataataatgacagctctggtctcccatgtcccaagcgtccactctgtgcctcatgctgttcccttcaccagcagttagttctccatctaatctttcttctgagaaaggcagggcagtcacggctccaactttacagatgaggaaattgaggctcggggggaagtcactgcctgaggtcaatgggcaaktcggggggcggtgccaggacccatgcctaggtcacaccccaagtagarttctgaccatggggttcaragttagcagarggtacggtggaccaccccatctgcagtcctccctggaggwcagatccgggactgctggactgwgyaacttcagggagggactgtactctctgcctcacagycttcatcaataaaawgaggatgacacgggtccctgcttcacagggatcccagggctcagaacacagtggggctcagggacaattctcaggttcatgcagttgatcaacaaatgcacattatagcctgaggaacatagggagaccccatctttacacaatttttttttttttgagccagantctcactctgttgcccaggtgga

SEQ ID NO: 4234 - DNA, 249 bp, Homo sapiens
  misc_feature (9)..(9): n equals a,t,g, or c
  misc_feature (15)..(15): n equals a,t,g, or c
gcggagatngcgccnttgcacttccacctgggtgacggagagagactccatctcaaaaaaaaaaaaaacaaaaaaaaaaaaccaaaacaaggctgggcgcggtggcttacgcctgtaatctcagcacttttggagkctggggcaggggtatcacctgaggtcatgagttgaagaccatcctgaccaacatggaaaaaccccgtccctkctgaaaaatacaaaattagccgggtgtggtggtgcatgctt

SEQ ID NO: 4235 - DNA, 1495 bp, Homo sapiens
gacagccgtatcagcctgctggtgaataacgccggtgtgggcgccacggcttcgctgctggagtcggatgccgacaaaatggacgcgatgattctgctgaacgtactggcgctgacccgcctggccaaagccgcggcaaccaactttgtcgcccagggccgtggcacgatcatcaacatcggctcgattgtcgctctcgctcccaaagtgctgaacggcgtgtatggcggtaccaaagcgttcgtgcaggcgttcagcgaatcgctgcagcatgagctgagtgacaagggcgtagtggtccaggtggtgctgccaggcgctaccgccacggagttctgggacatcgccggcctgcctgtgaaacaacctgccggaagccatggtgatgaccaccgaaaacctggtggacgccgccctggcaggccttgcccagggcgaagccgtgacgattccgtccctgccggacagcgcagattgggacacctacgaacgcgcgcggctggccctgggtccgaacctgtcgcaccgtgaacccgccgctcgttatgggttgaagtaatccggactagcgcagccgggtttaaacgcaggcttcctgattgcctgggaggcctgttcatacccgtaggcgaccgacagcaacgtggcttcgctcaaatttttcccatagaagtgaacggctgtcggcatcccttcgtcgtccatgcccgatggtatggagataccgggataaccggccaccgccgagtagtagtaactgtatgagtgaaagttggacatcattgcatcaagcttatgctcggccagcggcttatcgatggtgcttttgaaaatcgggccgatggcagcccataactcattgcgcgcctcatcactgatatccatcccgttgatcatggtgagcatctgttgatccggcacacccggaccgctgttgcgctcgttgaattcaatcagctcagccagcgacttcaccggcaagcctgcccgtccggccaggtaggcttcaagctggtgtttaacgtccgataacaacgcgtcgttatattgttcatgggtttcgtacgggacgccctcacccagttgacccacgggtaccaatgtcgcgcccttgcctcgcagcaacgtaatggcatcctcgaagtgctcctgtcggcttttttcgccgggtcgttggcatcttctacagataactcaggcaacggcgtataaccgatgcgcttgcccaccaaggcgtcaggcttgattccctgggtgtagcggttggtatccgtcatcgcatccagtgcttgcgccgcatcacgcacgttacgggtgaaggtgcccaccgtgtcctggcgggaactggtcatcacccttcggtactcactaatcttcggtcggtttgaaaccaataacaccgttgtaagccgccggcgtaatgattgaaccattggtttcgacccccaatgccaagggcacaatcccttgtgcaacggctaccgcagagcccgta

SEQ ID NO: 4236 - DNA, 1501 bp, Homo sapiens
  misc_feature (434)..(434): n equals a,t,g, or c
  misc_feature (441)..(441): n equals a,t,g, or c
  misc_feature (1300)..(1300): n equals a,t,g, or c
ggacagccgtatcagcctgctggtgaataacgccggtgtgggcgccacggcttcgctgctggagtcggatgccgacaaaatggacgcgatgattctgctgaacgtactggcgctgacccgcctggccaaagccgcggcaaccaactttgtcgcccagggccgtggcacgatcatcaacatcggctcgattgtcgctctcgctcccaaagtgctgaacggcgtgtatggcggtaccaaagcgttcgtgcaggcgttcagcgaatcgctgcagcatgagctgagtgacaagggcgtagtggtccaggtggtgctgccaggcgctaccgccacggagttctgggacatcgccggcctgcctgtgaaacaacctgccggaagccatggtgatgaccaccgaaaacctggtggacgccgccctgscaggccttgcccanggcraancgtgacgattccgtccctgccggacagcgcagattgggacactacgaacgcgcgcggctggccctgggtccgaacctgtcgcaccgtgaacccgccgctcgttatgggttgaagtaatccggactagcgcagccgggtttaaacgcaggcttcctgattgcctgggaggcctgttcatacccgtaggcgaccgacagcaacgtggcttcgctcaaatttttcccatagaagtgaacggctgtcggcatcccttcgtcgtccatgcccgatggtatggagataccgggataaccggccaccgccgagtagtagtaactgtatgagtgaaagttggacatcattgcatcaagcttatgctcggccagcggcttatcgatggtgcttttgaaaatcgggccgatggcagcccataactcattgcgcgcctcatcactgatatccatcccgttgatcatggtgagcatctgttgatccggcacacccggaccgctgttgcgctcgttgaattcaatcagctcagccagcgacttcaccggcaagcctgcccgtccggccaggtaggcttcaagctggtgtttaacgtccgataacaacgcgtcgttatattgttcatgggtttcgtacgggacgccctcacccagttgacccacgggtaccaatgtcgcgcccttgcctcgcagcaacgtaatggcatcctcgaagtgctsctgtcggcttttttcgccgggtcgttggcatcttctacagataactcaggcaacggcgtataaccgatgcgcttgcccaccaaggcgtcaggcttgattccctgggtgtagcggttggtatccgtcatcgcatccagtgcttgcgccgcatnacgcacgttacgggtgaaggtgcccaccgtgtcctggcgggaactggtcatcacccttcggtactcactaatccttcggtcggtttgaaaccaataacaccgttgtaagccgccggcgtaatgattgaaccattggtttcgacccccaatgccaagggcacaatcccttgtgcaacggctaccgcagagcccgtactcgag

SEQ ID NO: 4237 - DNA, 3389 bp, Homo sapiens
aaaagctggagctccaccgcggtggcggccgctctagaactagtggatcccccgggctgcaggaattcggcacgaggggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaactgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtctatatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcattggtgcctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaacaaaaaaaatgttaagaaatgggtttcttgccttaaccagtctctcaagtgatgagacagtgaagtaaaattgagtgcactaaacaaataagattctgaggaagtcttatcttctgcagtgagtatggcccgatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccactgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataataggaatttgtataaagcattactctttttcaataaattgttttttaatttaaaaaaaaaaaaaaaaaaaaaaaactcgagggggggcccggtacc

SEQ ID NO: 4238 - DNA, 1256 bp, Homo sapiens; identical to SEQ ID NO: 1300
  misc_feature (1240)..(1240): n equals a,t,g, or c

SEQ ID NO: 4239 - DNA, 687 bp, Homo sapiens
  misc_feature (28)..(28): n equals a,t,g, or c
  misc_feature (34)..(34): n equals a,t,g, or c
  misc_feature (55)..(55): n equals a,t,g, or c
  misc_feature (657)..(657): n equals a,t,g, or c
  misc_feature (660)..(660): n equals a,t,g, or c
  misc_feature (664)..(664): n equals a,t,g, or c
aaaccagcttttgccctgattacgccangctcgnaattamcctcactaaagggancaaagctggagctccaccgcggtggcggccgctctagaactagtggatcccccgggctgcaggaattcggcacgagcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattacaaaaaaaaaaaaaaaaaactcgagggggggcccggtacccaatttcgccctatagtgagtcgtattacaattcactggccgtcgttttacaacgtcgtgactggggaaaccctggcgttacccaacttaatcgccttgnagnaacntcccctttcggcagctggggtaa

SEQ ID NO: 4240 - DNA, 1022 bp, Homo sapiens
  misc_feature (937)..(937): n equals a,t,g, or c
  misc_feature (990)..(990): n equals a,t,g, or c
ggcacgagagagccrgcggcccgagccggggccatggcgaactgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccaggacagaagctggtgatctgctgtgargggaatgctgggttttatgargtgggctgcgtctccamgcccctggaanctggatattcatcckgggtggaatcatccagctttgctggaacacagggggtnccattcccgcaaaatgaaggctaatgccatgg

SEQ ID NO: 4241 - DNA, 1198 bp, Homo sapiens
cccacgcgtccgggagaaagctgcactctgttgagctccagggcgcagtggagggagggagtgaaggagctctctgtacccaaggaaagtgcagctgagactcagacaagattacaatgaaccaactcagcttcctgctgtttctcatagcgaccaccagaggatggagtacagatgaggctaatacttacttcaaggaatggacctgttcttcgtctccatctctgcccagaagctgcaaggaaatcaaagacgaatgtcytagtgcatttgatggcctgtattttctccgcactgagaatggtgttatctaccagaccttctgtgacatgacctctgggggtggcggctggaccctggtggccagcgtgcatgagaatgacatgcgtgggaagtgcacggtgggcgatcgctggtccagtcagcagggcagcaaagcagactacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgmtgaggtaccgcacggacactggcttcctccagacactgggacataatctgtttggcatctaccagaaatatccagtgaaatatggagaaggraagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcaccactgcattggtggaggaggatactttccagaggccagtccccagcagtgtggagatttttctggttttgattggagtggatatggaactcatgttggttacagcagcagccgtgagataactgaggcagctgtgcttctattctatcgttgagagttttgtgggagggaacccagacctctcctcccaaccatgagatcccaaggatggagaacaacttacccagtagctagaatgttaatggcagaagagaaaacaataaatcatattgactcaaaaaaaaaaaaaaaaaa

SEQ ID NO: 4242 - DNA, 2692 bp, Homo sapiens
  misc_feature (3)..(3): n equals a,t,g, or c
  misc_feature (7)..(7): n equals a,t,g, or c
  misc_feature (1962)..(1962): n equals a,t,g, or c
  misc_feature (2011)..(2011): n equals a,t,g, or c
aanaaantcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgratattagactaagatttgttttccaggaggctcaatctgaacacacagaatgtcagagctggaagggactatagagatcatctgatctgatcctcttgtacggatgatcgcaaaactgaggtgtagagaggggaatggccaaaatcacaaagcaagttagcgttaagagctgagactagaattcagggtcctcactcccaggccaccgaaccatgcagccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaastgaaatagctatgtggcggatacggaaaacagaggacaatttgaggatcttgctggaataataaatgacagctaccatttgttgagcacctattatatatcaagcctgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctggnattacaggcatgagccaccgctcctggcctctctttcttttttaaacanagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaatctcagaattctttttttgtttgtgttttttttttttttgagacagagtctcactctgttgcccagctggagtgcagtggcgccatctcggctcackgcaacctccgcctcccgggttcaggcaattctcctgcctcagcctcccaggtagctgccactacaggtgctgcaccaccacgcccggctaatttttgtatttttagta

SEQ ID NO: 4243 - DNA, 898 bp, Homo sapiens
aggaggctgaagtgggaggatcacctgggcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgttkttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttawwaamragaacctcaatatatagcctggataatggtgttgtgaaaa

SEQ ID NO: 4244 - DNA, 3579 bp, Homo sapiens
gcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctgaagcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctycagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaaaaaaaaaaaaaaaaaaaaaaaaaaaaaagggcggccgctctagaggatccctcgaggggccccaa

SEQ ID NO: 4245 - DNA, 986 bp, Homo sapiens
aaagacttgagcaagggcgtaatcttcaggaaggtcagtctggtagcatagtgtggattgggttgggggatggggaaggagagcagaaaattattgaaatatccaggtgcataaaagtctactttgattatggagaactacacacttgttcagtcaccctcattggagacgggggatggcatacgaaaagaatgctgatttcaggctgggcacggtggctcatgcctttagtcccggcgctttgggaggctgaggcgggtgaatcaggggttcaagaccagcctggccaatgtggtgaaaccctgtctctactaaaaatcaaaaaaaaaaaaaaaaaaaaatggctgatttcagagtcatattcaggtttaaattctgtcattcagcccaaactcattactttatgttacttatgggaacctcatctaaaaagcaaggatcctgatacctgcctcatattgtggcaaggatcaaatgagtcaaataagatgcttgtgaaagtgaggacaggatctatcctcaacacctagtgcaattctttttacacattaggtacttagtaatttgggttgaattgtgttgaactaacctggcggtataggcaaaatttggaagtttggttttcagaaagtcttgacttcctcttatctctaagtaattggcatgtcctctaattcatattttcccccctcatctgttgggtgaaatactgtttatcctttagtactaaaattaaaagttacctcattcttctagctagctgattttttttttaatctaggctaaatcatgaatacatttacatttaaataaaatattacagttgaaagtaaagggtcctttcattatctccacttccaattccagtaccctgtgtaaaggaaaacatatacatcttgcagacattttttaatgtgtttgtaatataggtacataaaaatatatgtgcttgttttaagcaaaaaaaaaaaaaaaagggcggccgc

SEQ ID NO: 4246 - DNA, 1059 bp, Homo sapiens
  misc_feature (954)..(954): n equals a,t,g, or c
  misc_feature (996)..(996): n equals a,t,g, or c
  misc_feature (1012)..(1012): n equals a,t,g, or c
  misc_feature (1028)..(1028): n equals a,t,g, or c
  misc_feature (1034)..(1034): n equals a,t,g, or c
gggcggcggctccgcgggggaaacagcgaggctggcgcagcgccgaggccgcggccctgggggcccgcaatccacgccacggaatccccgagtgagcaggggtgagcgcaccactgcccaacgcaaaccgtgaagaagcttctkgaagagcagaggcgccgccagcagcarcagcccgacgctggcggggtgcagggacaatttctccctcccccagagcagcccctraccccatctgtgaatgaggctgtgactggccaccctcccttcccagcacactcggagactgtgggttctggacctagcagcctgggstttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgkgagcataagggcaagacccctctcctggtggcggctgctgccaaccagcccctgattgtggaggatctggtgaacctgggagcagagccaatgccgctgaccatcagggacgttcggtcttgcacgtggccgctacctacgggcttccaggagttctcttggcttgtgcttaanctctggggtccaggtttgacctggaaagccagagactttccnggggccttaaccccgnttcaaaacgggccatncctggncccttaaccgttgctaatgcggccc

SEQ ID NO: 4247 - DNA, 891 bp, Homo sapiens
gtaccggtccggaattcccgggtcgacccacgcgtccgcccgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcargggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcacctagcatgatgtctgcctatcatagtcattcagtgattgttgaataaatgaatgaatgaataaca

SEQ ID NO: 4248 - DNA, 2355 bp, Homo sapiens
  misc_feature (1)..(2): n equals a,t,g, or c
  misc_feature (11)..(11): n equals a,t,g, or c
  misc_feature (17)..(18): n equals a,t,g, or c
nnactatgaanaagatnntgacctggcaatgccctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcmgatgggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgcacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttyagtttaacatcccagtggagaaagttaaaa

SEQ ID NO: 4249 - DNA, 1076 bp, Homo sapiens
  misc_feature (955)..(955): n equals a,t,g, or c
  misc_feature (1030)..(1030): n equals a,t,g, or c
  misc_feature (1034)..(1034): n equals a,t,g, or c
  misc_feature (1062)..(1062): n equals a,t,g, or c
tttgtttgaarcaggggtgtaccgccscatgatcagctatggtggtgccgactacaagcgaattactgtgaaagtcaatgccccatacaacaraatcaaccaaagaatkttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatggrcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgntttctgcatgactgagagtctcagtgttggaacgggacagkatttawgkatgagtttttcctattwattttgarnctgngargkcttcttgkcatgtgagtgggggntggggaaaggattc

SEQ ID NO: 4250 - DNA, 572 bp, Homo sapiens
  misc_feature (434)..(434): n equals a,t,g, or c
tcgacccacgcgtccgatggtttactgtgtagtctccccaagaagggccactctgttctgcgtactgctgttaggcacaagatgtgaaataatatctgtgaggtcttcatttggtgaatatgataaaatcaatagcattttaaagggtctcctaaaaataccatttaatgaattttaaaaattaatagtgaattattattattgagaacatttgttaaattagtgttttcttggtttggattggatgtaatgcataaacttcaaagatgtaaaaactgtatttaaaacattttttaaattttttgtagagatgggggtctcaccacgttgcctagggtggtctcgagctcttgggctcaagtgatcctcccacctcagcctccaaaagtgttagattacagtcctgagccatcakggacttaactatccttaantttgtatcacctatggagaacatgtattaactttgtaataaaaaagttttwaggccggtgcagcagctcytgcctgtaatgscagcacawtggggaggcygaggtgagarggtcacttgagcccagggagtttgaagg

SEQ ID NO: 4251 - DNA, 1728 bp, Homo sapiens
  misc_feature (4)..(6): n equals a,t,g, or c
  misc_feature (11)..(11): n equals a,t,g, or c
tcannntaganccttctggactatcctaggtacgcctgcaggtaccggtccggaattcccgggtcgacccacgcgtccgagtagaactgggaagagactctagaactgccagtcatctgtactataaaccatttgctgtatagacctcccttgtctgcaccatctcccacccaccccccgggcctctcacccagtgtgggcctgggctctcgggctttatccatgtctttagatttgtgtttgcccttttttgttttgttttgtttttgtttttgtttttgtttttatttttgtttttgttttcaaaccagcacagttcattggccactctgcacacattcagtattagcgtggagctkggattcctgctkgagcccctggaggcgacagcagcagcaccaggcagtctcccccgcgggctgcctcggacccaaccattgaccatttggccccggacccttgtggagggagtggggactgggcacctgcagtcctccttcctctctcctcatctttctcttcttcccatctctgcagaagagaggttttcaaatccaatttagtttccaaaaagtgtacatttggggggggggctgtttgagagagagagcgtgagcacgcgtgtgtgtgtgtgtgtgtgtgtctgtaagtgtggatttttttatcatttttttaaaaatacagtactctttgtatcggtctgtcatgggtctatagctgtttcagatatttttcagctgtacttgagcatctgaaactgcaagaaagaaactcattaaatgtgattcttcttactaaacaggcctgactgctgtagctatgtaacatcccctcccccacagccctttccccactccgctccctcctcagagaaagcctcccggccacacactcctcacaccccctacccccgtgtggtccctgccctgtaggctgtgtcctggcaggcaggtgggaacccccctagccaagtaccagacagggcagtgcacatgtcttgctccccccatggggacggcccacagcttcttggatgcacatagactgtgtcttttccccacccccacgtactcgtctcttcctagtgattctgttttgctgtttcaggaggaatgatacttcgttttgtttctttgaagagaaagtattccacgtgactgtggcaagaacgaacaccaaaaggtctcggttgcagatgttacaagcatgtgcagttgtgtgtgtgtgtgtgtgtgtgtgtgtatgtgtgtgtacctatatatatggtaagcatatatattgttgtgcagctagggggaagccagcaaagaagtgtgtatgtctttatgaaatgtttgaaaagagataagctgackgcttgataatcaytctcaggtgtaaagctccaagtgtaaataaaagtggcatttaacaaatcttttcagaacaaagtacagctgactatatataccaagaactaagctaaagaaacagctgagagcagccgagtcccacgagagggagaggaacttagaggctctgctctgtacttcttcaccctacttttctgtcaggaagtgggatgacgggaaatcacagactttggttgtatgtaaacggaaaaatgaacttggtgactcttctgggtttagtggagcctcggtgttgctttaacttagtttacacttttttatttgaaaacgaagcagcaatggatggtttaaaaaaaaaaaaaaaaagggcggccgc

SEQ ID NO: 4252 - DNA, 925 bp, Homo sapiens
  misc_feature (852)..(852): n equals a,t,g, or c
actctgtctcaaaaaaaaaaaaaaaaaaaaaagtcttctgtattttgtataaattggtggtggttggatctagaggcttgagcacagatgatttaatgagatcagtttccaggtttgcagrttcacaaacctttgttctcttaaattcttcttctttcttctcttttttggagacagagtcttcctctgtcaccaggctggagtgtagtggcacaatcaaggcttattgcagcctctacctcccaggctcaagaaatcctcccaccttagcttcttaaatagctgggactacaggcgcacgccaccaccatgcctggctaatttttgtaattttttgtagagacatgatttcaccatgttgcttaggctggtctcaaactcctgagctcaagcagtctgcctacctgggcctcccagagtgctggaattacaggcgtgagccactgtgctggctgttcttttaactttttaagttggcctgagaaagcttgcagagccttattctccagatgtctctttttacaattattcttctaactgccaaaagaagtaagaagtctcccgttttactgtgttgtatttcaatttttttttttttttaaaagggtttgaagtccaggcgcggtggctcacacckgtaatsccggcamtttggraggccgaggtgggcagatgacctgaggttgggggtttgagaccaactgaccaacatggagaaaccccatctctgctgaaaatacaaaattagtcgggcatggaggcacatgcctgtaatctcagctactcgggaggctgaggcaggagaattgcttgaatccgggaggcagaggttgctgtgagctgagatcgtgnccattgcactccagcctgggcaacaagagcaaaatccgtctcagaaaaaaaaaaaaaaaaaaagggcggccgc

SEQ ID NO: 4253 - DNA, 911 bp, Homo sapiens
tcgacccacgcgtccgtcttcctaaaagggatgccctccaaagaaattttaaaagaatcttatcaaggggccctggagaagaaagggatgtgagggtcaagtcacaactttgaggggaaatagaaagagggctcctttctgagaaagaagaatttcaaagagtccaagagaaccaaaaattcaggacccaggagggtaagcattcctgtttttgcaagcttcacagaccatttgagtgagtgggtttttcaggtgacatttaaatgaacaaataatatccatgtctcagggtcagaaatggtactttgcaactgattctgtccctcttgagaggcttctgcaagactgagagggtgggatgacttaatgaacattaaaaacaatgttattaggckggatatggtggcacatgcctgtaattctagcactttgggargctgaggtgggcaggcccargarttcaagaccagtctgggcaacatggtgagaccctgtatctaataaaaatacaaaaatttagccaggcatggtggcacacacctggagtcccagctactcaggagactgaggtgggaagatcacctgagctcaggaagtcgaggctgcagtgagccaagattgcactactgcactctagcctacatggataggagtgagacctgtttgaaaaacaaaaaacaatcaaaaacaaaaaaaaacaacccacacaatgttatttttaaaatactgaggggagagaagttggggaaaaaaagggaaaacctaaaactctccataatcctaccatcagaaaattacactaatgtgataagtgactttctcccctctgaatctccaattccattacttgtagtaaatatgaatcttattccacaaactcagacatgcaaaaaaaaaaaaaaagggcggcc

SEQ ID NO: 4254 - DNA, 3793 bp, Homo sapiens
  misc_feature (1102)..(1102): n equals a,t,g, or c
  misc_feature (1132)..(1132): n equals a,t,g, or c
  misc_feature (1199)..(1199): n equals a,t,g, or c
  misc_feature (1228)..(1229): n equals a,t,g, or c
  misc_feature (1231)..(1231): n equals a,t,g, or c
  misc_feature (3176)..(3176): n equals a,t,g, or c
ggggcttcatacaggaaatctattgctgtgtcaagttccagagaaaagcttctgttcgtccaagttactaaccaggctaaaccacatagacgtgaaggaaggggctagaaggaagggagtgccccactgttgatggggtaagaggatcctgtactgagaagttgaccagagagggtctcaccatgcgcacagttccttctgtaccagtgtggaggaaaagtactgagtgaagggcagaaaaagagaaaacagaaatgctctgcccttggagaactgctaacctagggctactgttgattttgactatcttcttagtggccgaagcggagggtgctgctcaaccaaacaactcattaatgctgcaaactagcaaggagaatcatgctttagcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactgttaagagtacatgccactgggaggtccacaatgtgtctaccgtgaactgccacgtctcccatttgactggcaacaagagtctgtacatagagctacttcctgttccaggtgccaaaaaatcatcaaaattatatattccatatatcatccttactattattattttgaccatcgtgggatncatttggttgttgaaagtcaatggctgcanaaaatataaattgaataaaccagaatctactccagttgttgaggaggatgaaatgcagccctatgcnttttacacagagaagaacaatcctctctnngntactacaaacaaggtgaaggcatctgaggcattacaaagtgaagttgacacagacctccatactttataagttgttggactctagtaccaagaaacaacaacaaacgagatacattataattactgtctgattttcttacagttctagaatgaagacttatattgaaattaggttttccaaggttcttagaagacattttaatggattctcattcatacccttgtataattggaatttttgattcttagctgctaccagctagttctctgaagaactgatgttattacaaagaaaatacatgcccatgaccaaatattcaaattgtgcaggacagtaaataatgaaaaccaaatttcctcaagaaataactgaagaaggagcaagtgtgaacagtttcttgtgtatcctttcagaatattttaatgtacatatgacatgtgtatatgcctatggtatatgtgtcaatttatgtgtccccttacatataccatgcaccctatctttgtcaaggcaccagtgggaacaatacactgcattactgttctatacatatgaaaacctaataatataagtcttagagatcattttatatcatgacaagtagagctacctcattctttttaatggttatataaaattccattgtatagttatatcattatttaattaaaaacaaccctaatgatggatatttagattcttttaagttttgtttatttcttttaagttttgtttgtggtataaacaataccacatagaatgtttcttgtgcatatatctctttgtttttgagtatatctgtaggataactttcttgagtggaattgtcaggtcaaagggtttgtgcattttactattgatatatatgttaaattgtgtcaaatatatatgtcaaattccctccaacattgtttaaatgtgcctttccctaaatttctattttaataactgtactattcctgcttctacagttgccactttctctttttaatcaaccagattaaatatgatgtgagattataataagaattatactatttaataaaaatggatttatatttttggtcatgtttgtaagagagtgaatgcacgtgtgagaacattagcttcttctgaactcattatatctccacagaggtgttgatacttgatgcctaacagttttgcagatgtgctacattggaattgtgtatttttatggtgtacattctattgtgatatatttattgaataattaatgtctattgaccatataagtggcgaaaaatgcaccatagaggacatggggtatttatttacaaactatgagctacataataagcaagtggccatgggatggcatgaccctcccctccatatttttgtggagcaaaatattggcaatgtttatgtaaatcattgttaatatcatgaaattatttttaattaaaaacataagtctatttgctccatagcagaaaaaacatgagaagttttttcatcatgatagaaattgaaacaaaatatattcattcttcaatcataccatctgagatttttaagacagctattttgtcttataagtatatttttctccctctagacatttcagttactatggattttgtcctcaaagggacytttagtctaattttgggatgtaaagctaatcttaatgacacttggcacatgatattttgatcaagccattttgacttgaccaaaaagcagtgtccattaggtttctgcatataaatattaccaagcaatgttcacaatagacatcattacactgtccttgaaatttattaattcttcatccaaccctggttgagctgaggctcatagttaggttcaagactatctgtttaaatattactgaaaaacaaagtaagacagtactatgcttacctcttaacttgataatgtcaaaccaggcatgttaaatgacatcatagaaaaganttcaagataatttatagaagttaaattatattgtacagaaaataattgtatgaaaatctctactatggggctggaacatggttgaacattagaatgatataaaaaattatatatattctccaaatccacgctagacctgtcaaattagagaatctagagattagacctggcgtgtcagcaaggtcatccaggaagcagaggctgagacggagttaggtgtgattacttacatagtcgattacattttacaaataacattttatatgtctcatttactgtgctttctccccatcccattttgtatcttttcctttgctttgctagatttgtcaattttctctctctttctgtctctctctctttcaatatctctaataatttgaaagtaattcatcataactaaatatctattggggttatgcttcacttacaaacttctgaaaacggctttactgagatataattgatatatttaagtgtacagtttgttaaattttgcacatatttaaaatgtggactttggtaaatgttgacatagttttacatctgtgaaaccatcagcataatcaagataataaacttgtccatcaccccccaaaaaaaaaaaaaaaaaaaaa

SEQ ID NO: 4255 - DNA, 3789 bp, Homo sapiens
  misc_feature (3677)..(3677): n equals a,t,g, or c
tcgacccacgcgtccgatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcakgcctccgggctgcaggagagagacatgcagctgggcttyctgcgggctttgccggarctgggccccggrggtgaccagcagtyctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaamgatgaaktggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagraaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacacccnccaccatggtgggcttgtggtggctgctccatgagggtgggggtgatactactagatcacttgtcctcttgccagctcatttgttaataaaatactgaaaacacwmaaaaaa

SEQ ID NO: 4256 - DNA, 423 bp, Homo sapiens
  misc_feature (26)..(26): n equals a,t,g, or c
  misc_feature (338)..(338): n equals a,t,g, or c
  misc_feature (422)..(422): n equals a,t,g, or c
gtgacactatttaaggtacgcctgcnggtaccggtccggaattcccgggtcgacccacgcgtccgggaagccgccggctggtcccctccccgcggcgcctgtagccttatctctgcaccctgagggccccgggaggaggcgcgggcgcgccgggagggaccggcggcggcatgggccgggggccctgggatgcgggcccgtctcgccgcctgctgccgctgttgctgctgctcggcctggcccgcggcgccgcggagcgccgggccccgacggtttagacgtctgtgccacttgccatgaacatgccacatgccagcaaagagaaggggaagaagatntgtatttgcaactatggatttgtagggaagggagactcagtgtgtgataaaaatgatgccaatttggagccactcttgtctgtng

SEQ ID NO: 4257 - DNA, 1666 bp, Homo sapiens
acaacgagggaacaagtgcctgtagtgtgtttggatctgtaccctacgactgattatacggtgaatgtgaccctgctgagatctcctaagcggcactcagtcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtgagaagacactcctgtgcagtttgggctcaggtgaaagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctgccatgccaataagtttcctgctgtgtctgttaggcagcattgctttgatgcaatttctattgtcctatatattcaaaagtaatgtctacattccagtaaaaatatcccgtaattaaraaaaaaaaaaaaaaaaaaaaaaaaaaaaaaaaaaaaaaaaaaaaaaaaaagggcggcc

SEQ ID NO: 4258 - DNA, 1138 bp, Homo sapiens
  misc_feature (6)..(6): n equals a,t,g, or c
  misc_feature (8)..(8): n equals a,t,g, or c
  misc_feature (496)..(496): n equals a,t,g, or c
  misc_feature (1074)..(1074): n equals a,t,g, or c
  misc_feature (1119)..(1119): n equals a,t,g, or c
  misc_feature (1123)..(1123): n equals a,t,g, or c
  misc_feature (1128)..(1128): n equals a,t,g, or c
ccctgnancccccactcttgtttgtgggaacccacatcttgccacaacacccccgggggcttctattgcatttgcctgkwwggatatykwgccacaaacaacaacaagacattcattsccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctncagaaatgcggcacgccatcttggtaggaaatcacagcttcagtctggtcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagrtgatggaagtttcaatatttcaatatttaatgaaactkgtttgaaattgaamaggsgttytaggaaagttggatcagaacacatgtaccaatttaccgttctgggtcagaggtgntatctggctaacttttctcatgcaacatcgtttaacttcacaacnaggnaacanggcgcctgta

SEQ ID NO: 4259 - DNA, 2295 bp, Homo sapiens
ccacgcgtccgagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggaggcctgtgacatctctgtgccctgctctttctcctacccccgacaagactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactactccccgaagctgctgggcccctcctgctcctgggaggctgagggtctgcactgcagctgctcctcccaggccagcccggccccctctctgcgctggtggcttggggaggagctgctggaggggaacagcagccaggactccttcgaggtcacccccagctcagccgggccctgggccaacagctccctgagcctccatggagggctcagctccggcctcaggctccgctgtgaggcctggaacgtccatggggcccagagtggatccatcctgcagctgccagataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctaggaggaaggtagagtagaagttgaagataaccgagtgcaagagtttccttctctccctctctctctctctttctctctctctctctctttctctctctttttaaaaaaactctggccacggcacagtggctcacgcctgtaatcccagcactttgggaagttgaagttgggccaaatcccctgagtccggattcgaaaacagcctggccaacttgtgaaaacccgtctctacttaaaaatacccaaattacctgggcattgtggcaggggcctgtttatcctt

SEQ ID NO: 4260 - DNA, 1344 bp, Homo sapiens
gtccgagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaagactggacagggtctaccccagcttatggctactggttcaaagcagtgactgagacaaccaagggtgctcctgtggccacaaaccaccagagtcgagaggtggaaatgagcacccggggccgatttccaggctcactgggggatcccgccaaggggaactgctccttggtgatcagaagacgcgcagatgcaaggatgagtcacagtacttctttcgggtggagagaggaagctatgtgagatataatttcatgaacgatgggttctttctaaaagtaacagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccaggggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactactccccgaagctgctgggcccctcctgctcctgggaagctgaaggtctgcactgcaactgctcctcccaggccagcccggccccctctctgcgctggtggcttggggaggagctgctggaaggggaacaa

SEQ ID NO: 4261 - DNA, 1892 bp, Homo sapiens
ccctgcctgccggcggtcccgctggctagawgaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccarggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtacacaaggacccccagcccctgtgcgggtggaactcagggctgggagccaggtcctggcgcagtcagccctgacattctgctcgctcactgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaaaaaaaaaaaaaaaaaaaaaaaaaaaaaaaaaaaaaaaaaaaaaaaaaaaaaaaaaaaagggcggcc

SEQ ID NO: 4262 - DNA, 1517 bp, Homo sapiens
gggtcgacccacgcgtccgctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggcccggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacagggcagcctatgacattccccccagaggccctgtgggtgaccgtggggctctctgtctgtctcattgcactgctggtggccctggctttcgtgtgctggagaaagatcaaacagagctgtgaggaggagaatgcaggagccgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgcctttttttcttatagacacaatgaacagaccacccacaaccttagttctctaagtcatcctgcttgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgca

SEQ ID NO: 4263 - DNA, 2751 bp, Homo sapiens
taaccctcactaaagggaacaaaagctggagctccaccgcggtggcggccgctctagaactagtggatcccccgggctgcaggaattcggcacgagtagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcrttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccatgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccgggrctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgrgcctttaggtgaatgtgggatccactcccgcttttaacatgaaagcattagaagatgtgtggtgtttataaaaraaaaaaaaaaaaaactcgagggggggcccgtacgggaattcgccctatagtgagt

SEQ ID NO: 4264 - DNA, 1546 bp, Homo sapiens
agcgtccgccggccccggaacccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaaaaaaaaaaaaactcgagggggggcccgtacccaattcgccctatagtgagcgattc

SEQ ID NO: 4265 - DNA, 584 bp, Homo sapiens
  misc_feature (469)..(469): n equals a,t,g, or c
  misc_feature (509)..(509): n equals a,t,g, or c
  misc_feature (519)..(519): n equals a,t,g, or c
  misc_feature (531)..(531): n equals a,t,g, or c
  misc_feature (536)..(536): n equals a,t,g, or c
gtaccggtccggaattcccgggtcgacccacgcgtccgcattttaacatctctaaatcaggatctgtcttataatcaaaagtgcatcatatttaacagatggcgtgttttctttcttagtagtacctaaagtaatacaacttaaaattgatggcattttagatttaataaaatatgttcatttctttgttcatttttggtctggtgaggctttggccctgttgtgtagttatttattttgtttatagtatttgtaaacaccagtgttctcaagaggctcattcatcaatatttaactgcaaatttgtttcccagtctcagttttctataatgtaatccattgtggggaaggggaagctaaaaatcagtattcygccagtatttyctatatagawgtcataaaaccaaaaataccatcatgtattaatattcctacawggtggcaagacagcactttggaattataaaanccaacttaattcctttgccaatgccaaaactgggttggancttccaaaancccactacccanggttnggagggttcaataataggccaaaccaaatggtaaaaccaccaccacaa

SEQ ID NO: 4266 - DNA, 684 bp, Homo sapiens
  misc_feature (173)..(173): n equals a,t,g, or c
  misc_feature (243)..(243): n equals a,t,g, or c
  misc_feature (663)..(663): n equals a,t,g, or c
  misc_feature (668)..(668): n equals a,t,g, or c
  misc_feature (681)..(681): n equals a,t,g, or c
  misc_feature (683)..(683): n equals a,t,g, or c
aaaaccccatacgggcagaacttccccaggaagcctctaggtggcagcacaaccgcaccactcctggagtctaattactacttttctgtggctcagtaggaaaaattcttgactatttccattacatcttaaacagttaccatgatttgccttaaaactagtctcttatgaancaaacctgatgaggcaagttctatattcccttttcttgattttccaccatcattcttgtcctcttgactnttcggttccgttttctcagtggttgcctgaaaaagagatttttttcccccttgaataaatgattcctttaaaagttctaaaaattattttttaagcagtaatttttaggtcaacaaagtggtttggccatatgaattccctcttctacttcccaggcagcttcatggcgagagcctggattggttggaaggagacattctatggagaacaggacacccatgcggttcaccatctcmccaaacctcctatgactgccttggacgcacatcccmcattttcttttctttcaccaccaaaagctcaaaatcatggctatcacctacttgttcttgatagcctacttgttcaagctggcttaaggtaataacaccagtgaagtctttttgtggttctttaaaggttacaattaggttcggaggncaaantcaaggcagaagngna

SEQ ID NO: 4267 - DNA, 2070 bp, Homo sapiens
  misc_feature (108)..(108): n equals a,t,g, or c
catcccacctttttccttttcctttcaccaccaaaagctcaaaattcatggctatcacctacttggttcttgatagccttacttgttcaagctggcttagggtcatancaccagtgaagtctttttgtggttctttaaaggttacaattaccttctcagtggcctgtcttggcatagttgcctgtggcccttaccattgtggatttgagcctgcagttctcatccttcctgggctcccagtgaatctctattactggagttctaattcattctctccttttccctctcctccccactttcagactactcttttctcactggttcttactccttttcatcaaaatatgggtcattctgaaagatttcaactggaccctgttttcctccacttgtgctgaattaccctcaaatatatcaattattcccatggattcaccattacattctccgtgtataactcgtattttcatctccagctgtgagagtccatcagagcttcggtttcmcctctagggtcaatggccttctcctccaaatttgacaatttctgtttatggcagcagttcttcccatcacataaactttcaagtgatctttgactcatacctcatgaatattcatcatttgccaagtccttctaagtttctaacatactagttttcatatcaatcatttcctttctgtttctatggctgggactccaggtttgcctttcttccttgttctccactaagaagtctctgtgatttgaacctcactgtccaatccacttggtacatcactgtcatgttcatctccatggcacctccagtaattactctaatgcttgtgttcctctctctcagtagtacttcaattgtgtcagttttatgcttgatggaatttataatagtaaaaaaaattgaaacaacttaaatatccaataattggggaatgattgaatgaattactgcatgtccataaaggcaatataatcatgaaaaaataagatgttgaataatagttaatgatatgtgaaaatacttactaatgataggaaatgtaaactgtatacatagwwtgatgtttacatgtatatgattatatacatgcctatacataaacatatagaaaaaaagatagtaagaaaatacaaaaatgttaattgtgattatttttaatgtgcttaagttttgggtgacttttccttctctttacatacattttatatattccaaaatgttctataatgactatgtattacttctgtaattggaaaacaaaatcaatgtaattttacattgtctttcactgggagccaattgactctagaatgaagtccaaaattatcctgctattacaaaatttacttagtaaaaataaataaaatgttaaattaaatactagctagattatattttgataattaaagagagcaagttaatgactattgcattttttggtagaagtttcttgtaaaaagctaaagttaaattytaragtgtgtatgaaatattgcataaattttaaaaggttttaagataaaggctaaagttggtttcagaaaaggcattattaactcataaaatatccccatgggttctcgagaactatgaatttattcgtctctcataagtatatatattttatccataaatcaaattttgcctctcaaaatgaaaggtatttaaagttaatgcattggtggaaaccatcactgaattctttaaaaacaaagaaattttaaacaacaaaactttcaagtttctaaaaggttttacaatagcatctagtggcaaaaatgtgatttttctttggaggatggagtagttttgaaatcctcataattagatgggcattttctaatgacagatagtcatgtatcaattctgaaagaacataatattaagttaaaacacacttttaaaaccctaggcaggaaatatgcatcaccttggattttgtaatattttaatatatcaataagtctgacttgamyccctgcaagagacttaaatgagtgagaatagttaactggtctgttttgttatatttaggttatggtacatgtgtgtgtttacattgtgggct

SEQ ID NO: 4268 - DNA, 427 bp, Homo sapiens
  misc_feature (44)..(44): n equals a,t,g, or c
tcagcttactggctagtctctctccataatcatcctatttgttnggcaattggtaattctgatgccactggatttggataacaggaaccctagaaaattattattcctgatataataggttttaaagtcttgtttttattaaagtttcttccttgtttagagtctcatctcattcacattagtttgatttgttttcaggtacagagtctaaaaatattcatcagttacaccagttgttcgcaaccttgattactcttgggaatttaaaaaataacaagctagctgggtgtggtggctcacaactgtaatcccagcactttgggaggccagggcaggaggatcacttgagcccaggagttcaagactagcctgggcaacccagaaagtcttcatctctaaaaaaaaaaaaaaaaaaaaaagggcggcc

SEQ ID NO: 4269 - DNA, 2871 bp, Homo sapiens
  misc_feature (1234)..(1234): n equals a,t,g, or c
  misc_feature (1259)..(1259): n equals a,t,g, or c
  misc_feature (1283)..(1284): n equals a,t,g, or c
  misc_feature (1287)..(1287): n equals a,t,g, or c
  misc_feature (1378)..(1378): n equals a,t,g, or c
  misc_feature (1912)..(1913): n equals a,t,g, or c
  misc_feature (1935)..(1935): n equals a,t,g, or c
  misc_feature (1947)..(1947): n equals a,t,g, or c
gcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttaggattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccaggtagtctggacattttccttgctttttgatttatttaggggacaactgaaaattttaagctaatgaataaagaagctgaagaagactggcttcactgattattacccacaaataatatatggagtgtagtttggagagaatttctagattttaatataccaaagttattcacttaacagatttgacccaagttacataagctgaattccatagatgagattgcatttatctttttattaatatcctgacgtttctttttggaatcaagtatgtaaatacctttctcactgagaaatttaaaaaaataatatgtcagggtagcatacaaaacagaaactcaggaagaactgtctaacatgccactatggttattttcaggattgtggtaggattattactacaataaccttgtcgatcatcctaggtaatttgatttaggtgtttatccctccagcttgacgcttgtgtgtacttccatcctattctaactttcacaatcttgaaacctctacttttcaatttaaaacttgacctttttcacaatagtcttctaaatattaatccttttaaaaattattaatgtatgcattctaccatgtcttgttgcccttctgtcatttattatttcaatgatcactgccttatctgtttattattccattactaaccactctcaggaactgatccaaattggaactttttaaaaaaatagaatttttttttactacaaatataccattctcatgaatagaaaactatttttaaaaaattaaaagtacctgaatcccatcaactagaaataacagntgctcacatcatggagaatattctntcaggatttttttaggtgtatcannagntttaagaaaagtaaattgggtcaaaatgtgtattctatgttgcagcctgcattttgcacttaacagtttaccatgaatgtttttccatgtnatttagcttattttcaatttgatagttaatggctataaaaaattttatttgtaaatatatggtaccataaaccaaaacgtttatgttttgctgggagatcattttagatgtatctttgtgcctatctgtgaaaatttccttagaattcttaaagtaaatttgctgaattggatgtaaaagtttaaaagacagtagatacacattgttaaattgttcttcagaaaagtgattctgtttacttcctctgaaaatacctctttccctgtacctcacccaagtgtgtattaccattttaaaatttttactaaatataatttaattcattcttcattttttaattagggattttttttttttttttttagtttttatatttttagagacatggtctcactctgtcactcaggctggagtgcagtggcacgatcatagttcactgcagccttgaactcaggtgatctccctctttggcctcccaaagtgctgggattacaggcatgagacactacatcaagcctgggaaatttttaaacnngcataaaaagtagagggtaaantgccaccccttnccaaccctcactcagcttcaataaacatcaacattctgctggtcttttcatctttactaccctacacacatttgccctttttttctttcctagaatattttaaggcaaattccgcatgtgcttttacatctctgtgtctctctctagtaagaatgctcttttcagcaaaatcacagaattagccattactcctttattacctaatacccagactgtttaatttttctagttgcttcaagtgtctgtttacaatttatttgtttgaattcatttctaagctactcaggaggctgagtcaggagaattgcttgaaccctagaggcagaggttgcagtgagctgagatcgtgccactgtactccagcctgggtgacaaagtgagactccatgtcataacaaaacaaaacaaaacaaaacatgacgaaacaaacaacacaattgaataatatccctcagttattatttagagaagagatgactcaatataaatgtaatatgtgatccatttggtcacagaatgaatttcagtcattgcttaggtaagcctggtaaaaaaaaaaaaaacgggattccatgattagtgtgttgaaaaaggggtttgcccaaagtgtaacagacagagccgggtgcagtggctcacgcctgtaatcccagaactttgggaggccaaggcaggcggatcacgaggtcaagagattgagacaatcctggccaacatggtgaagccctgtatcaactaaaaatacaaaaacaattagctgggcgtggtgacatgtgcctgtagtcccagctactcaggaggctgaggcaggagaattgcttgaacctgggaggcggaggctgcagtgagctgagattgctccactgcactccagcctggccacagagtgagattccatctcaaaaaaaaaaaaaaaaaaaaaaa

SEQ ID NO: 4270 - DNA, 1714 bp, Homo sapiens
agccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagttacgtgtgggacccgctgctgatcctgtcgcaatcgtcctcatgcagaccgtgtattacggctcgctgggcctgtggctggcgctggtggacgggctagtgcgaacagcccctcgctggaccagatgttcgacgccgagatcctgggcttttccacccctccaggccggctctccatgatgtccttcatcctcaacgccctcacctgtgccctgggcttgctgtacttcatcacggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggcccctttaacaccttgggctgctcagaccctccagatgaggtccagcccagatctgagaggaacccggaaatgtgaagtctctgttggtgtgggagagatagtgagggcctgtcaaagaaggccggtagcagtcagcatgacagctgccagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaaggccataggacccagataagaatcccagcgttgctcaaagtctaaccattcataaaagacactggcctgtcttctaggaatgaccaggcaccccagcttccactggacttccaattttttttttcctggccttaatttaagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttcaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4271 - DNA, 1680 bp, Homo sapiens
  misc_feature (306)..(306): n equals a,t,g, or c
gccccggaaacgtttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaanagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacakaattggaaccatgccactcttgagccacaatacctgtcaccagcctgttgttttaagagagaaaaaaaatcaaggatatctgattggagcaaaccacttctttagtcatctgtcttaccyccctgggacagctgttacctttgcagtgttgccgaatcacagcagttacctttgcartgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagygttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatgaaaaaaaaaaaaaaaaaaaaaaaaaaaaaaaaa

SEQ ID NO: 4272 - DNA, 1386 bp, Homo sapiens
  misc_feature (1313)..(1313): n equals a,t,g, or c
  misc_feature (1329)..(1329): n equals a,t,g, or c
aggcccctggttctgtgaaagaaggtgaaaaccttccagagagaggtggaggcgagccccaagagctcacaccctccccctccacttcccctctcctgcaccaactgctcagaggcaggaagttgagggggtgtgtgagcccccaccacagacacacacacaacaaaccaaaacacataaacacaaatacctacacacataagtagatacacaccactgcactccagcctgggcaacagagccagactccgtctcaaaaaawtaaaaataaaatatgcatatctgtgccctcctagtcttaaacagctactgaattatgctgtaataaatgggctttccagtgctaattatttctgcctctataccaaagtgccacaggccatgcttctcttggcttctgggctctcttctgccttcccttatgactccctgggatttacgctttccatgctgctgtttttcgagagaaacaaatcacgtgttgaagtcctggctaaggagccgtcagctcccagcagttattgggactctgagaaccgtggttgtcagctgtgaggtgcaggttccttgttctcagaagcgttctagctggcgggagctggacaggtttcctctggaacacaattttacctggtttcacatctgactggcaggaaaaagggaagcagggcaagtgaggttagggctacccgggacagacggggatggacggagccatgtcgtcagcgcccagtggagttctgactgtaaaggaacacaccggtacgccctccttgtgaaggatgctatcccttccccaccaccggtgattttgtctctgggataaatgtgaattttcacacctgttctcttagggtaggagtcagcaaactatggctcacaggccacatccagcctgctgcctgttttttagggccatgagctaagaactaagaatggcttttatatttgtaattggttgggaaaaaaaaaaaaaaarggcggccgstctaraggatccctcgaggggcccaagcttacgcstgcatgcgacgkcatarctctctccctatagggagtcgaattataagctaggcactggccgtcgttttacaacgtcgtgactgggagatctgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagngattctaattgtttgngtattttagattcacagtcccaaggctcatttcaggcccctcagtcctcacagtctg

SEQ ID NO: 4273 - DNA, 1538 bp, Homo sapiens
ccacgcgtccggctggcgcacgccccgggaccccgagaggccgccgcggcacatccagacctccgccgctcccgcgccctctcaaccatcctgggattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggggtcgtcggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagacggcgaggggaccgacctgtttgccgtggctgtccatgagtttggccacgccctgggcctgggccactcctcagcccccaactccattatgaggcccttctaccagggtccggtggggcgaccctgacaagtaccgcctgtctcaggatgaccgcgatggcctgcagcaactctatgggaaggcgccccaaaccccatatgacaagcccacaaggaaacccccggctccttccgccccagcccccggcctcgcccacacacagcccatccttccccatccctgatcgatgtgagggcaattttgacgccatcgccaacatccgaggggaaactttcttcttcaaaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcgggccccagttctgggtgttccaggaccggcagctggagggcggggc

SEQ ID NO: 4274 - DNA, 757 bp, Homo sapiens
  misc_feature (532)..(532): n equals a,t,g, or c
  misc_feature (662)..(662): n equals a,t,g, or c
  misc_feature (735)..(735): n equals a,t,g, or c
  misc_feature (737)..(737): n equals a,t,g, or c
aagtacgcctgcaggtaccggtccggaattcccgggtcgacccacgcgtccgcgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaanaggcttgggtctgacactccggggctttgaccaggagctgaacgtggactggcgagatgagccagarcccagtgcttgtgarcargtgtcatggkttccagaatgkaccactgaaattcctgacactcangaaatgagcgattggatggtggtgggaaagagaaagatgattattgaagatgaaacagagttttgtggggaananctgcttcacagtgtgttgca

SEQ ID NO: 4275 - DNA, 979 bp, Homo sapiens
  misc_feature (3)..(3): n equals a,t,g, or c
  misc_feature (951)..(951): n equals a,t,g, or c
  misc_feature (976)..(976): n equals a,t,g, or c
aangtacgcctgcaggtaccggtccggaattcccgggtcgacccacgcgtccgcatyacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcamccamattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagaagcgtacattggatccatgcggcctctgaaaatgggtgggcncgtaaaaagggttttggaaaaattnttt

SEQ ID NO: 4276 - DNA, 1993 bp, Homo sapiens
ggtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtraaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtgstggcttcttccccctcttgaaaagggactggggagcattgcacctggcatgaggagtgggtggcctcctctccatcccctgaagagctcaggcagggccctgcagagaacactcatgttccttctgggacacctgcctgggaactttcccctgccaggactcagcctgaaggaagctgctcctgaggcaggtatgaggtcagtgctagggcacgtgggactgatggaggacatatcagagtrgcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatatttttaaaaaaaaaaaaaaaaaaaaaaaaaaaagggcggccgc

SEQ ID NO: 4277 - DNA, 377 bp, Homo sapiens
gttttgtggggaagagctgcttcacagtgtgttgcagtgtaagagcgtgtttgatgtcttggatggggaagagatgcggcgagctcggactcgggccaatccctatgagatgatccgaggagtcttctttctaaacagggcagcaatgaagatggctaacatggattttgtatttgatcgcatgttcacaaatccgcgggactcttatgggaagccactggtgaaggaccgggaagctgarcttctgtactttgctgatgtctgcgcaggcccaggtggcttctcagagtatgtgctgtggaggaagaagtggcatgcaaagggctttggaatgactttgaagggccctaatgacttcaagctggaggactttactc

SEQ ID NO: 4278 - DNA, 468 bp, Homo sapiens
gtgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattatyctcgaaaagcaatacctgcagtggctcgaacgaccacgctcaatgagg

SEQ ID NO: 4279 - DNA, 181 bp, Homo sapiens
  misc_feature (178)..(178): n equals a,t,g, or c
ggtcagtgtgcagatagccttggataccagktactggactttcattaatcacgtcttcatctgggggagcattgccatttatttctccattttatttacaatgcacagtaatggcatctttggcatcttcccaaaccagtttccatttgttggtaatgcacgacattccctgacccanaag

SEQ ID NO: 4280 - DNA, 612 bp, Homo sapiens
  misc_feature (47)..(47): n equals a,t,g, or c
  misc_feature (534)..(534): n equals a,t,g, or c
  misc_feature (537)..(537): n equals a,t,g, or c
  misc_feature (563)..(563): n equals a,t,g, or c
  misc_feature (565)..(565): n equals a,t,g, or c
  misc_feature (591)..(591): n equals a,t,g, or c
cagtctgggcttaagaaaccaccagaagaacccaaaccagaaatgcncaagtgtaaatgcaaaaattcttatagaagaaatagcataagaatttgcacattcggaaataagaccaccttccatgaacaaggagaagcctttggagatatctaaactgtgcaaatgaatagtcgctggctaagactgcttgcaatccttcctggccgctgatgccaacaccaatgtgagcacttttaatcatgctgacatcattggctccatcwccaatggccaaagtaacagcatttctgtacttcttcaccagctctaccacttgggctttctggagtggagtgaccctgcagcaaattacagtcttacacatgcaagcaagttctaggagatcattcttgacatcactttctagggcatgagccaaactgtggccatttatgattaaggcataatctcctgttatggtttcttctacaatagaatccaactccagctgctgctttttttcacaaactacatggccattggaaaaatttctgnttngtccaaacaaattttgttttgaaatnangagttcttctctcacttccacagcanttattccctgctatagggagg

SEQ ID NO: 4281 - DNA, 1024 bp, Homo sapiens
  misc_feature (29)..(29): n equals a,t,g, or c
  misc_feature (986)..(986): n equals a,t,g, or c
tgctttcctgagttcttctctcacttccncagcattattccctgctatcccaaacmcatcattcatgtcgtcagtcagcatgttgcaggcataaccgatgttgatgscagtttcttgtttgtctcctgttaggacccagatcttaatattggctagtgataaacttgtaactgtttcaataacaccctcctgtaacttatcttctacagcagtggcacctagtagcatcaaatctctttcaatttcttcatatagcccagctattcgttcatccctctcttctgtggcaacattcgcatcttcaagcatcttatgccactctttaaagtacttgtcatccaggtctctgtatgcgatggccaaggtccgaaggccttcccctgcaaattcactgaggtggtctgacgtcaaagacaaaaggacttcattggaaggatsaagtttctcaaacagaatagtatctgctcctttggaataaagctttatctgtccttctgggtttcgarctatgacagacatcctttttctggtgttgttgaaatccaaaaaggcaagtaattgataagtaactagtgttcccaattcttctattgttatggtctctggggtccgggatttaaaratgaacccaaaatttctagcggcagtcactagagccccttcatcaggtgactgaacttggtaaatcagctctcctgcgctattctcttctgacattacagtgtggcagagagcaagtaacctaaggaattcatgaactttgggatcacccattttaatggattccatcagattgtggtcaaagaactgaaattctctatccgcttgagatttgactgagaaatccacaggctctttttcctgagttatttctgtcttctgatccaggtcatcatgtacttcaccatagattctcccattaatggaacatcttttaaaggtcatgatgttttgagtgagggtacccgttttgtcggagaaaatgnactcaatctgccccagttcttcattgagcgtggtcgtt

SEQ ID NO: 4282 - DNA, 366 bp, Homo sapiens
gacgcgtgggagctcattatccatcaaactcactcargtgwcacytgagtgagtttgatggataatgagctaatgtgatatctataggtcacaattttttaaaaccaaaattttcaagtctgggataatctttcctaaatgggatcaaatgaaataatatgtgtaaaagagtcaaatgcagtcctttaccatagtaactgcctatggacgttgtctttcccttacatgcctgcctacacttaaccagatgttggttttcaagtctaatktgtcattagtttcaccacattkgctcacttttkgtaacatttttgcaagatttgaaaactttcagtaaatgttttggcactattggtaaaaaaaaaa

SEQ ID NO: 4283 - DNA, 519 bp, Homo sapiens
  misc_feature (371)..(371): n equals a,t,g, or c
cctggttagggtcctacagggaaataaaattataaccgtggaggtacatttctctaccagaaagcaaaaataaagcatcatgtcttaatggttttctacaaatcaacttctaattctacagagtccttaatctggtccctattaaattcttggtcagacaaagttacatttcccaagagagtcaggtgacacttgagtgagtttgatggataatgagctaatgtgatatctataggtcacaattttttaaaaccaaaattttcaagtctgggataatctttcctaaatgggatcaaatgaaataatatgtgtaaaagagtcaaatgcagtcctttaccatagtaactgcctatggacgttgtctttccctnacatgcctgcctacacttaaccagatgttggttttcaatgtctaatttgtcattagtttcaccacatttgctcactttttgtaacatttttgcaagatttgaaaactttcagtaaatgttttggcactattggtaaaaaaaaaaaaaa

SEQ ID NO: 4284 - DNA, 566 bp, Homo sapiens
gaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaacagatcaagtggctgctgctatgtgggccgg

SEQ ID NO: 4285 - DNA, 1764 bp, Homo sapiens
cttaaaatggaaaaagccttaaagtgkcaaccctattgccttaaaggggaattaaaggaagattytcctattattcctgtktccggaycaacctattaaccctttaggataattgttttatgtgaaaaaaattagaaatttttytaaagcaaaattagtactattggtttttatttattttactgttcttaatacagttaacttatgaccaacagcatggattatttatacagggtttgaaaatgcctctcaacaaccacaaatacaataggcagcaaataccaggctcaagaaattagcagtgactcaataggacgcactgtatgtttgatgactggcaccactgttgttctttaccatcacagataatcaatatttaactgggctgcatatttattatacttttatatttgtaaaacagttaccaagtttattttatattgtcaaaactttaaagatcatactattaactgcttgtctcacgtactgatgaatggttcttgagcccaatttttcccctactaaatataatctagtctgtcacaacctagtttcttcatattaattttgattactagaaggtaccagctagcaaaggcaggatgacagttcttcacaataaacccttggctctgaacaaacatgttaaacagagggattatttctgtgatgcaaatactggagaaaaaartggaggtagcactaaggctattctgccacttaacatatgaatggtgtgaaagaccaaaagatactaaattttgtttaaaatttcttaactattctatagcctaaaaagtaaggcataaagtcccaaagataaatacaaaaatctccattcctcattctgtcccagtcawattgagatttgtatttgggtcataaatttttctgcagcatttggatacctcrggttacaacaaacatgagagagttaaatgataaaagttaatgaaattaagttatgattttaacttgtgagttaggagaaagtaaacaaatatgaagtgcaaaaataacctttcctgagatctgtgtgcttcaggaatgtggaagcctggccacagtccatctctgacctccttatatagtaaatcacataatgtccacacaaccacacacaaacacacttgcacaggcacacgcaaacaactaagtaacttacataaaggcattaagcatagatagagagaagagcacttgtctctcttttcttctgaattttttaacaataatctttaagactaacagcttaagacataatggtgacaactcaggcttttatcaaatggtctttgctttttttttcaaataggtttccttaaaatatttcttcatttgctatatcttttctgtctgctccaattttatttaccatcacagagcatttcctacctcaagagggtacttgagatacaaactaattaaaggtaaatataaraatataggaagcttttcctccctaatatacaaaattcacaaattgcataaagatttctgttgttttctttacaaatatataaatttattagaaaaacatgcctactaaattttggtatattttcatttaaagatgtatcacatcttcatcgcaaaatacaagcagaggaagtatttttctcaaaagccatttttagtatttctagttaggattgatgttacctaatgatttcctaccacaagatgttacctaatgatttactaacaattttactatggtcagcgttatcttattagcaaatgcaccgaaacaaaacacaagga

SEQ ID NO: 4286 - DNA, 960 bp, Homo sapiens
  misc_feature (954)..(954): n equals a,t,g, or c
  misc_feature (960)..(960): n equals a,t,g, or c
gagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattctwctttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatktaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggamagtamtgctgctgttatttatatgcaattcttctggtaaatagcrggaggggtaccctaggacttaaanaataan

SEQ ID NO: 4287 - DNA, 1308 bp, Homo sapiens
  misc_feature (1290)..(1290): n equals a,t,g, or c
ccttccatgtatgatgcagtcacaaagaaacacttttcttwctctawtgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttyccaaaataaatagaacagaggtttataacaaactgaaaaactgtagccctcatatgaatgkttatctcaaagaagacattcctaacagattttattaccaacataatgatcgaattcagcccattattttggttgccgatgamggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatmctaagtgcttgttagttgaccagtggtgcattaatctcccagaagccatcgcgattgttatcggttcactcttggtgttaacatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgktgtaactatggaaaaagaatactttgaaagacaaagaacttagactaagcatgktaaaattattactttgttttccttgkgktttgkttcggtgcatttgcyaataagatacgctgaccatagtaaaantggtaggaaatcattaag

SEQ ID NO: 4288 - DNA, 709 bp, Homo sapiens
  misc_feature (1)..(1): n equals a,t,g, or c
nctcctttagtaccactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgarttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgctttaaaraaatgtgtatgtagtgccttaatttaaattaaaatatttttgactgttacttgagttcagaattaatgactttgttcatgatttttaaaatgtgtgtg

SEQ ID NO: 4289 - DNA, 2031 bp, Homo sapiens
  misc_feature (138)..(138): n equals a,t,g, or c
  misc_feature (722)..(722): n equals a,t,g, or c
ttctccatcattcacatcatcgccaccctgctcctcagcacgcagctctattacatgggccggtggaaactggactcggggatcttccgccgcatcctccacgtgctctacacagactgcatccggcagtgcagcggngccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttrctgacactggatracgacctggatactgtgcagygggacaagatctatgtyttctagcaggagctgggcccttcgcttcacctcaaggggccctgaagctcctttgtgtcatagaccggtcactctgtcgtgctgtggggatgagtccccagcaccgctgcccagcactggatggcagcaggacagnyaggtctagyttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccatagctgtgggcaccccagtgcytaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcagaaaaaaaaaaaaaaaaaaaaaaaaaaaaaaaaaaaaaaaaaaaaaaaaaagggcggccgc

SEQ ID NO: 4290 - DNA, 2031 bp, Homo sapiens; identical to SEQ ID NO: 4289
  misc_feature (138)..(138): n equals a,t,g, or c
  misc_feature (722)..(722): n equals a,t,g, or c

SEQ ID NO: 4291 - DNA, 2926 bp, Homo sapiens
  misc_feature (353)..(353): n equals a,t,g, or c
ttgggcggacgcgtgggcggacgcgtgggcggacgcgtgggcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcgganccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcatctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccaggraagggtagcacgtgcagctctcaccgcagatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccrcttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaaaaaaaaaaaaaaaaaaaaaaaaaaaaaaaaaaaaaag

SEQ ID NO: 4292 - DNA, 2926 bp, Homo sapiens
ttgggcggacgcgtgggcggacgcgtgggcggacgcgtgggcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggascggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcatctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccaggraagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccrcttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaaaaaaaaaaaaaaaaaaaaaaaaaaaaaaaaaaaaaag

SEQ ID NO: 4293 - DNA, 2924 bp, Homo sapiens
ttgggcggacgcgtgggcggacgcgtgggcggacgcgtgggcccgcccgccccgcgcgggggccgagtcgcgaagcgcgcctgcgacccggcgtccgggcgcgctggagaggacgcgaggagccatgaggcgccagctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggascggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcatctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccaggaaagggtagcacgtgcagctctcaccgcagatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccrcttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaaaaaaaaaaaaaaaaaaaaaaaaaaaaaaaaaaaaaag

SEQ ID NO: 4294 - DNA, 2951 bp, Homo sapiens
  misc_feature (378)..(378): n equals a,t,g, or c
cccggctcccgcccgctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcgganccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcatctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccaggaaagggtagcacgtgcagctctcaccgcagatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccrcttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaaaaaaaaaaaaaaaaaaaaaaaaaaaaaaaaaaaaaag

SEQ ID NO: 4295 - DNA, 2720 bp, Homo sapiens
cccggctcccgcccgctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccakcctactgmaacacgcctccgcccccgtacgaacagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccaggraagggtagcacgtgcagctctcaccgcagatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccrcttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaaaaaaaaaaaaaaaaaaaaaaaaaaaaaaaaaaaaaag

SEQ ID NO: 4296 - DNA, 2950 bp, Homo sapiens; identical to SEQ ID NO: 697

SEQ ID NO: 4297 - DNA, 777 bp, Homo sapiens
  misc_feature (708)..(708): n equals a,t,g, or c
gcaaaaagctatttaggtgacactatagaaggtacgcctscaggtaccggtccggaattcccgggtcgacccacgcgtccggttaagttctatggccgctgcagggtctgtgaaggcggcgttgcaggtggccgaggtgctggaagccatcgtgagctgctgcgtggggcccgagggacggcaagttttgtgtacgaagcccactggcgaggtgcttctcagccggaatggaggccgcctcctggaggcgctacacttagagcatcccatagccaggatgatagtggactgtgtttccagtcatctcaaaaaaacaggagatggtgcaaaaacatttattatctttctttgccatttgcttagaggacttcatgcaatcacagacagagaaaaggatcctttgatgtgtgaaaacattcaaacccatggaaggcattggaaaaattgttctcggtggaaatttatttcccaggctctcctaacgtttcagacacaaatattagacggtattatggaccagtacctaagtagacactttttgtctatcttttcgtctgctaaagagagaacattgtgtaggarctctttaragttgctcttagaagcatacttttgtggaaaagtgggaagaaataatcataaatttatttcacagttgatgtgtgactactttttcaagtgtatgacttgkaaaagtgggattggtgnatttgagttaggggatgaccattttgtaaarttgaatgttggtgyactggccttcctgtttaaattcca

SEQ ID NO: 4298 - DNA, 2102 bp, Homo sapiens
  misc_feature (22)..(22): n equals a,t,g, or c
  misc_feature (24)..(24): n equals a,t,g, or c
  misc_feature (35)..(35): n equals a,t,g, or c
  misc_feature (83)..(83): n equals a,t,g, or c
atcgactcgggagtttgcgctntntgcaacctggntatgaagttcctacctcaacctctgtccttcctgcaaagcaggaagantctgtcaagatcctgctggctgagttcaaggctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtgaggctggaccaggactagagaagcttgagcacccccgagttgctgctcattgaattcctccactttcttatatagcctcagatgctgtgatgtctgaccttgtggatatttgcccttggaatttctactttactttctaccgtaattccttctccgtacccaggtcttctctgagagaagctataatttaatctgtgaggaactaaatgacaggagattggtgctaatacgggggaccaagctttgtccaagtgaagcaggcttcgactccttctgagargtctggtgtgttcctagaatctcaccttttcttcccttgctaaagcatgaagtttggcatttggcacactggaagcctggttgaaatgaaatttgtagcrtctgatacaaagccagrgacattctagcaagtgcagcasccccttctttctctgtaacagagatatcatttatgtggagatccacaacctttaacagggatccaagatctttgcagttcaatcgaccacataggaatttccaggcaccaaaatgatataacttccttgcttccttgacaaagaagccatcatgggtgtgatccaagatccctgtcgtagtgttgatgatgttagtacatgattttaaaggttagaaccccttctaaatgaatggtctgtggaagattttagtatcttatctgatgcctggtatgatgaggatagaaaatttttccatttttatgtgcctcacaggctgtttgggcattaattttgctttttgagccttaagtgtgttagtaggatggagaaactgtgatggggactgggaacctggatttgtctgattttaggtcactgttccctgggcctgtttttgtgagcccttacacaggaagatataaagagagttctttcatttcactgctaaaatcagtatgtagtatggggaatgtatttgggttgtttttaaagaaaaggggaacagaatcaggagagtgggcaaaggcaataaaatcaaagttcttattaattaaaaaaaaaaaaaaaaaaaaaaaaaaaaaagggcggccgc

SEQ ID NO: 4299 - DNA, 727 bp, Homo sapiens
  misc_feature (726)..(726): n equals a,t,g, or c
ctgcaggtaccggtccggaattcccgggtcgacccacgcgtccrgtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtggccgggactggctggctctaggtccccggctcgggtggggtcacacggtcctgccctagagcccccatctggccctggagctgcagaagcagcttctgaggggcttcccaggcctgcatttcacagatggggagctcagccctcgaaggccgcaragacgcctcccaggcccgtctgccagggcgccggccacaatcctgcagggccaaggactggactccaggcaagtccctgcgctccagctggacggccctgttccagggaggaggtgctcggttgacaccatcagggarggagggtgggcactgctgggctgagttcacccccagggctggccagatggggccaggaggacaganc

SEQ ID NO: 4300 - DNA, 857 bp, Homo sapiens
ggcacgagctgcgatgagaggtgcaggaggcaggagcctggcccagggggtgctggtgcctccccggggtctgggcggagagaacaggaggaatggctgggaagtggctgagggagccaggaggccggggggccgggggctgcaggggaggctgtgggggtcctggcagccaggaggccccaggtggttttgaggctcgctcttgcgcggtgcctgagaagagggtgaaggagctggggcaggccccatcctgggcattggagatgatgaaaccgagcagacctggcccatgtggagctggcatgggggacacagcmcagagasagagargcttatgaggaagtgaggaggtggcgtmacaagggtggggagggggccttgggkaagggcggccttggatcagaggctcaccacaagcctggcatttcagccagggctggagaaggcagggacgcctgggtgagaggcaaagggcacagccatgcaaaggccctggggcaggacggcacctggtatgcgggaggaacagagtraggagaggagggcagggcgtgcagggccttgtgggcctcagggaggacttgggcacctaccccgagggagtggagctcctgggtgcgtgtccagatgggaaaggcagggtcgtatctgtggggacctgacaagggcaggggaagcggagaccagggtgcagccgcccccacccaaggccgggcccagccagaggaggggcagggcagggcaggaggtttctggatgtttgttgggtttggtttggttttgttttgttttgtttattgtggtaaaatacaaaatctaccgtcttamarwraaaaaaaaaaaaaaagggcggccgc

SEQ ID NO: 4301 - DNA, 583 bp, Homo sapiens
ccacgcgtccgggacatctgccggctggagcgggcagtgtgccgcgatgagccctctgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctactgggccccacttctctggatcagagaccctgcctctgtttgaccccgcactgactgaataaagctcctctggccgtttaaaaaaaaaaaaaaaaaaaaaaaaaa

SEQ ID NO: 4302 - DNA, 355 bp, Homo sapiens
  misc_feature (10)..(10): n equals a,t,g, or c
  misc_feature (19)..(19): n equals a,t,g, or c
acactatatntagggacanctgcccgtaccggtccggaattcccgggtcgacccacgcgtccgtactgccctttttyaacctcagatgtgactttcattataggaagttctcaggcattttctcttggaataatacctcttctctcttctctttatgtccttgtgccgcattctgggttattcctttagctctaggttaagttcactaattcttcctttagctgtatttcattattgtttaagctgtccattgcattttaaactttctttcaaatatcttcccttcccttcctttcccttctcttccctgccctgccctgccctgccctgccctgccctcccgtcccctcccctc

SEQ ID NO: 4303 - DNA, 1095 bp, Homo sapiens
gcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaatyttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactg

SEQ ID NO: 4304 - DNA, 696 bp, Homo sapiens
  misc_feature (606)..(606): n equals a,t,g, or c
  misc_feature (676)..(676): n equals a,t,g, or c
  misc_feature (679)..(679): n equals a,t,g, or c
gcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgttwctgcctggttactgacctttcccactatggaccctaagccattggcatatgccatccagaatgttagytttgatataagtattgtcagcctgatctccttgatctggwctctggctattcttcttttgagtaagaaatataaacagcttnctcatatgcttacaactaatttactcattgctcagtctattgtctgtgctggaatgatgatatggaatcntgntaaagaaaaaaattttg

SEQ ID NO: 4305 - DNA, 737 bp, Homo sapiens
  misc_feature (565)..(565): n equals a,t,g, or c
  misc_feature (647)..(647): n equals a,t,g, or c
  misc_feature (717)..(717): n equals a,t,g, or c
  misc_feature (720)..(720): n equals a,t,g, or c
gcaggtaccggtccggaattcccgggtcgacccacgcgtccgcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagntttgatataagkattgkcagcctgatctccttgatctggtctctggctattcttcttttgagtaagaaatataaacagcttnctcatatgcttacaactaatttactcattgctcagtctattgtctgtgctggaatgatgatatggaatcntgntaaagaaaaaaattttg

SEQ ID NO: 4306 - DNA, 1822 bp, Homo sapiens
ctactactactaaattcgcggccgcgtcgacctttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcaaagggagacaaggaaacgggcacagcgaaatcctggtgaagagcaaagcagaagaaatgacagcagaagccatggcacagacttgtatagaggagaaaaaatgtacagagagcacccaggaggtacacatactaaagtgacacaaagagaatgaagcagaagtagagaagaaagactgtatgtgacaattacctgggaataaaaatatctccacttttttattgaatacctttagcaaggggtaaattatgtactgttgtctttctaataaaaaagctcaattttaatttttcatctctagactgtcaattcaagtacaaaactacatgagtactatgagaatgaattttgcaaatatttgtaagtaagctattttggggctgtggaaatattttctgttggtaactgtttcttgttccccataccagataaaaaccgcatataactctgtgacattttctttgttctgaaacatcattaaaagaatgacagtacattgaatgggtataatttacttttttcaattcaaatttgttattctaggatttgaatttgcttgaagtgaattgtaataattattcaaattcattagtataaattaaggattaataaatctttaagacttttaaa

SEQ ID NO: 4307 - DNA, 615 bp, Homo sapiens
  misc_feature (13)..(13): n equals a,t,g, or c
  misc_feature (506)..(506): n equals a,t,g, or c
  misc_feature (520)..(520): n equals a,t,g, or c
  misc_feature (544)..(544): n equals a,t,g, or c
  misc_feature (548)..(548): n equals a,t,g, or c
  misc_feature (595)..(595): n equals a,t,g, or c
ctaggtgacactntagaaggtaccgcctgcaggtaccggtccggaattcccgggtcgacccacgcgtccggttccttwaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggccggccgggccgcggnccggacgaataccnagaagccgctacagcggcgccttncctncgcaacttgcgtgccagatgccccgaacttgcacggggcatggtcgncttttgggctacgacactac

SEQ ID NO: 4308 - DNA, 370 bp, Homo sapiens
  misc_feature (288)..(288): n equals a,t,g, or c
  misc_feature (352)..(352): n equals a,t,g, or c
ggttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccaccttcggggcccgtnggccggcctgggggggtatccgggccgtcgtggcttgcaaccgccgggggaccgggcaacgcanaacccgcgcaaagctccg

SEQ ID NO: 4309 - DNA, 344 bp, Homo sapiens
  misc_feature (6)..(6): n equals a,t,g, or c
tccggnaattcccgggctaggagacctgttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggarcaagtgaggcaaagtccagaaaacgctgcatctccccaggcaaccaacag

SEQ ID NO: 4310 - DNA, 1182 bp, Homo sapiens
  misc_feature (1134)..(1134): n equals a,t,g, or c
  misc_feature (1160)..(1160): n equals a,t,g, or c
tacatgtccagtgatgatgatgttgatatgagtctttttctttcccattttcggtttgatttaggggtagttttcatgacacctgtattctggtggcaaaccctttgccaaaaagctgcttaggtcttttgtccattttgaatagatttttgtgtatagtgtaagataagggtcaaatttcattcttttacatgtagacatccagttttcccaagtgtttgttgaagagactatccttgcctcattgtgtgttcctggtacccttgttgaaaattagttgaacatatttgcatgggtttatttctgagctctctattttgytccattggttatatgtctgtctttctgccagtaccgtactgttttaattactgtagctttgtaatatactttgaaatcaggaaatatgaagcctccacctttgttcttctttctcaagattgttttarctatttggggtcctttgtggttccatatgaattttaggtttgktttttctatttccatgaaaaatgccattgggattttgatagggattgcattgaatctgtagattgctttatgtattatggctattgtaatgatgttgaagtcttccaattcatgaacatgggatgtctttttatttatttgtgtctcttaaaatttatttyatcagtgttttatagtttttcatttgcraatctttcatttccttggtcaatgytattcctaagtattttattctttttgatcttatagtaaatgagattgttttcttaatttgcttttcaaatagtttgatgttattgtatacagacacagctgattttgtatgttgatttttatatcctacaacaaatttttctgaatttgtttagtatgtctaataaatttttgatgcactctttagggttttctacatataaggtcatgtcatctgtgaacagaaataattttacttttccctttctaatttggatgccctttatttctttttattgccgaattgctctgactgtgacttccagtactatattgaatagaggtggtaagaataggcattttggctttggttctgacttaaggaaagacttcagtttttcactattaagctaatggtaactgkgagkttttcatatatggccttcattnttttgagatagtctcaccctgtttgnaggtttgctgagatttttatta

SEQ ID NO: 4311 - DNA, 1074 bp, Homo sapiens
  misc_feature (15)..(15): n equals a,t,g, or c
  misc_feature (17)..(17): n equals a,t,g, or c
  misc_feature (20)..(20): n equals a,t,g, or c
  misc_feature (22)..(22): n equals a,t,g, or c
  misc_feature (103)..(103): n equals a,t,g, or c
  misc_feature (381)..(381): n equals a,t,g, or c
  misc_feature (1042)..(1042): n equals a,t,g, or c
  misc_feature (1064)..(1064): n equals a,t,g, or c
  misc_feature (1073)..(1074): n equals a,t,g, or c
tgaggttttttccananaangncctttccattaattttgaagatagtctccaccctgttttggaagtttgttgaagattttttatttatgaaaaagtgttganttttgtcaaatgcctttctgcatctattaagagatcttgaagaaagtgaagagtaaagagttactgaaatttcttgcttagaagattagataaatggtgatgcttactaattaaggraaagtagaawtttttraagaagataaatagataagtcttagmcawaatgkgttttatttcttcaaacattctggttaaaatatcaaagtamcagttgttgcaaatggaaaaaatatgcagctctgagragmcattggaagcatcgataatacttagaaaanccttacctaatgctgccccaagcactttactcttgtaaattcatctaattatcactgtamcaccacaaagtagctattagttgttatcttattttatagatgagaaagctgaggcacagagaggccatgtcactcgcctgaggttccacggcttttaagtggcagaacattgatttgagtcaatgcattctgaactctgtgttcatgttctcaactatttatactattctgcttcagaaataaagactcccatttactaagcattttaacatgctagacattgtattgaacattatttgtatcatatcaattatctaatcctcaatacagctcttttatttcacagaataggaaattgaagcaaagagaggaaaagttgcatgaacgattttacacagctgttaggtcgttgaactggattctgaacctagcattctggctggagagcccaagcttttatcagttgtgtatagcagtgagagtagattccccatggaaaggtaagagctgaatacagagtccagagggaacaccaatatgaagaaggagttgtgaagcggcctgaaaagaaatgacaaagataggaagagagttacaaaaaaaaaaaaaaagggcggccgctctagaggatccctcgaggggcccaagcttgcgcgtgcangcgaagtcataggagcttttcngttagtccnn

SEQ ID NO: 4312 - DNA, 397 bp, Homo sapiens
  misc_feature (322)..(322): n equals a,t,g, or c
  misc_feature (394)..(394): n equals a,t,g, or c
  misc_feature (397)..(397): n equals a,t,g, or c
gtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgcggaacttttattacggtcgcgcgctttagctactcanaggcggagcgcgagagtaacaggctgacgcgccttcctacgtgcgctaggctgggactggggacccgacggnggn

SEQ ID NO: 4313 - DNA, 1574 bp, Homo sapiens
ccacgcgtccgggaggacccgggagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaaaaaa

SEQ ID NO: 4314 - DNA, 635 bp, Homo sapiens
  misc_feature (37)..(37): n equals a,t,g, or c
  misc_feature (539)..(539): n equals a,t,g, or c
  misc_feature (547)..(547): n equals a,t,g, or c
  misc_feature (628)..(628): n equals a,t,g, or c
cccgactctgattaccgcccgaattcccggtcgaccncgcgtccgggaggacccgggagccggcggccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcaacatgccgcaccaagtgcaccarcccgtccacggagctyarcatcacctycaggggcgcgacgctkcttggtggccaagaccaaggccttytccagcggggtaaagtttgggaaagcccaagagcttgcccttgaaccaaggccctggaagattaaanccgcccangggcaaagccggggaaaaaaagcccaaaaaagctctttcaatgcaccgccctttaaggaatgggaccccgggaactttccnggggacc

SEQ ID NO: 4315 - DNA, 2543 bp, Homo sapiens
  misc_feature (5)..(5): n equals a,t,g, or c
  misc_feature (2020)..(2020): n equals a,t,g, or c
aaagnccccagaatagaggacactctctggcttgwttaggccwctcccscgggtaagttggaagccagagctgccctgaaccaggccctggagwtgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaagaaacagcatttctagaaacctagtcacttcctaaagcaaaaggagaaacattctttacctccaaatgttttagttttaaaaaaaaaaaaaaactaagttaagccttgtctctaaagtagtttatacagttcttcagttgtataaatagcacagagtagtttttgaaaggttaagaaaaataagtgaaaagacatacacgatatatgaaatggctccaaatgataattgttcaaacctttataaaatgtgttttcgtactcttatgctgccagaggtacttcttaaaactcttctcgtcttggttttataagcacaccacggaggtctgacagatgtgcttgcttctactacagagcaagagaatttgcactttagctatatgtgaaggatattattttaacaaattcctgattctaataaagttattttattacatgaatgcttgagactgtcttatttgggagatgttcccatctgtcataagggcagtgggggtattctgacctttagccctattcataatactgttctgggagagcaacagatccaagatggtgatttccatgggcaagagacccagaagttggataaaccgcctacctaggtgggcaaggatgaattactgatttttttttactaacaaacagtcaagtaactgaagtagtttttcacatttctatttatcatcagttctggattttctggggaaaacacacgaacccactcatgtagtcctggaaatccatttctagaacagtcaacacccggaacctaactgggttctgctcaagcctgaaaaggtttgcccctgtaccaagcctgggctgacatctgcaagtgtgacnttaaggtcagaatactggctgcagcaaagccaaaccgttaatgtgaagcagcaaaagtaaggccacactcacccatagtgatattcagggctcttcatgtgtcaggtccccaaccatgagggctctgagctacccaaatcatcacaccagctgaacagtccatcagccttccaagcagcatcacagagaacactgcaggaggaacgcgtgggacagcaaaggttcttgctgctgtcaatagccgccgcttgaatttaattcagaagtaaagcctagtaaaaagttggttttgtataaaaaagagatggaggggaacctaccttttaagacttaagaggcttaccaaccaataatttacagggaggagagctgatatttgtaggaaggtggaaatttgagtggacagttgatgacatgaagggattaccactaatgtttctaggagtgaaggcctttcagtcctcctgagacacctgccgcaacattactggatgagcacaatgacatctggaacgctcgtgcc

SEQ ID NO: 4316 - DNA, 1073 bp, Homo sapiens
  misc_feature (1035)..(1035): n equals a,t,g, or c
  misc_feature (1065)..(1065): n equals a,t,g, or c
  misc_feature (1071)..(1071): n equals a,t,g, or c
  misc_feature (1073)..(1073): n equals a,t,g, or c
gtcagtatttctgtcaacaaaattcatgaggctctttgtacgcacagacttcaggcctttctctcaacaatcgccaaagctggagcatcacatggaggaacactggggtttgaaaaacaggaatgttccagaatcttctcagagtattacattttccaacatgtccatcccatatttgtaccaacaaacagagctggtcccactgccctcatcctttgtctaccatgttaggctgaggaagttgcatgcagagcagaggtgaagactaagagaagaagatacaagaaacctgctgagtaggggagagggaaatggtacctytgccagttatgctggaaaagctaaatgaaacccaaatcttgatggaggtgttagggttttcagtctttcaagagaagctcaggacacaggctttttggcttaaggaccccaaatttcctgggcaccacaaaagtagtaacggcagtcctccaggtgaatcagtgtcaagagctagactgtaatcacttgccttttgttgcattacaagccactcttgaaacacttagtggattgaaacaacaacttcttatttctcaatgattctttggcttgactgggcactctttctgctggtcttccctgggcagttcttctgctggttctgcctgggctcactcatgaggctacaggtagctgctgggtcagccagtgtctggggctcagctgggatgacctggcctctctctgcctgtggtcctttatccagcatgatggtctcagggttccaagcaagtaagccccaatgcacaagtatttatccagcctttgcctgcatcgcgcttgctcatgtctcattggctaaaacggatcacgtggccaagctcagagtcagtgtgggaagagtctatacaagcgcttggatactgaaaggcatgattcattgsgggccattgktataatctaccacacattctagactttgctttgctttagatccgaattctagcaactcgatgtgataaccctgggcacatcatgttggtcgaacactgnaattggctattgatgtcccttgggaatgtntgagangn

SEQ ID NO: 4317 - DNA, 616 bp, Homo sapiens
  misc_feature (2)..(2): n equals a,t,g, or c
  misc_feature (6)..(6): n equals a,t,g, or c
  misc_feature (21)..(21): n equals a,t,g, or c
  misc_feature (44)..(44): n equals a,t,g, or c
  misc_feature (48)..(48): n equals a,t,g, or c
cngtgnacccggtcagtttgnctgttactatcatctgccagtancctnagttccaataaagccagaggcaagattaacatctcttcctttttctttctaattcttctgctccccacattgccataactactcccattttctctatctctgtttactcaatggcggccttctatcagtcagtcacataaaagtattcttattgcagtcatttacactttagwatgaatgagtcagcacttttttgcagcaattttcattggaagccagtgggaagtgaaaggctttggccacccctcataatatatgacttaaagcctgcttgcaatagagagcccttgcagagtctctaaaagaaaaggacctgccccctgaagaacttctgagaccatagacctcatggtgcccagcttttcctggttgccatgtgtcatctctaaagacagccatgaatatctgttttggttgacttgagccatttgaatgtctaaaacccatcttaataacaaaagctctttggagggaccctaattaacttctttaaattgctttctctaaacttttggaattaatacaatctgttcccttgttattaaaaaaaaaaaaaaagggcggccgc

SEQ ID NO: 4318 - DNA, 1193 bp, Homo sapiens
acactatataagttacgcctgcaggttaccggtccggtaattcccgggtcgtacccacgcgtccggtaatgtcaaaggaaaagtaattctgtcaatgctggttgtctcaactgtgatcattgtgttttgggaatttatcaacagcacagaaggctctttcttgtggatatatcactcaaaaaacccagaagttgatgacagcagtgctcagaagggctggtggtttctgagctggtttaacaatgggatccacaattatcaacaaggggaagaagacatagacaaagaaaaaggaagagaggagaccaaaggaaggaaaatgacacaacagagcttcggctatgggactggtttaatccaaacttgaaggaatccgaataactaaactggactctggttttctgactcagtccttctagaagacctggactgagagatcatgcggttaaggagtgtgtaacaggcggaccacctgttgggactgsgagattctcaaggggaaggactgggtctcatttctcccatctcagcgcttagcaggatgacctggtatagagcagggaactgggaaatgtgggtcaggggatcagacactccagttgggtcttttatataaattaaatggcaaaaggctccatacccttctccttctttcctaccctccactttatctgcaaaatgggaatgatgataacacccacttcatagaatggtcatgaagatcaaatgagagaataaaagtcaagcacttagcctctggtgcacaataagtattaaataagtatacctattcctccttttccttttttaaaaataatattaccaaatgtccagcttatacacatttacaagacttagctagtgggctatgttagagctactaaaagatctttgacaagctaaaactaagatgcaatgaatgaggtgtaacgaacaagagagttttaagttcagaaatggttacagaagtataagacagctgtgtgggtgttttttggtttttggtttctggtttacaatctcgtcattcaacaaagatgggagttttatagaactaaaagcmccatgtaagctactaaaaacaacaacaaaaaaggctcatcatttctcagtctgaattgacaaaaatgccaatgcaaataaaaatgattactttttattttaaaaaaaaaaaaaaaaaaaaaaaactcgta

SEQ ID NO: 4319 - DNA, 3317 bp, Homo sapiens
gttcctctgtcatgcttcttggcatgatggcacgaggaaagccagaaattgtgggaagcaatttagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgaggggcccagaggcgaactgcagcagcttctgcagtgctggacccagaagaaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaactgagttacaaaaaggccatcattctcactcgagaagccacaggccacttccagggagtccgaacccttcagtgcatatagacccagaggagttcagagggagaccaggctcttggaatgatcttgaggacttatctttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtccctctggagcgctgttcctctgtcatgcttcttggcatgatggcacgaggaaagccagaaattgtgggaagcaatttagacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttaaaaaaaaaaaaaaaaaa

SEQ ID NO: 4320 - DNA, 3337 bp, Homo sapiens
gttcctctgtcatgcttcttggcatgatggcacgaggaaagccagaaattgtgggaagcaatttagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattccttgagcaaattgccaatacagagacaactgaagatgtgaaaggacgcatctatcaactgcttgccaaactragttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatmatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgkgagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgyctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttaaaaaaaaaaaaaaaggscggccgttctagatcgcgggcggccgc

SEQ ID NO: 4321 - DNA, 856 bp, Homo sapiens
  misc_feature (414)..(414): n equals a,t,g, or c
  misc_feature (684)..(684): n equals a,t,g, or c
aactactcctattgaaggtacgcctgcaggcaccggtccggaattcccgggtcgacccacgcgtccggtggcagagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggaracgagggccccgggcggacgccgmagagcgccgaggaggctttcctgctggtggcaaccgnctacgagacactcaaggatgaagaaacacgaaaagattatgattacatgctggatcatccagaagagtactacagccattactaccactactatagcaggcgcttggccctaaggtggatgttagagtagtgattttggtcagcgtgtgtgctatttcggtgtttcagtttttcagctggtggaatagctacaataaggcaatcagctacctagccacagtgcccaagtaccgtatccaagctacagagattgccaagcagcagggactntcaaaaaagccaaagaaaaaggcaaaaacaaaaagtccaaagaagaaattcgtgacgaggaggagaacatcataaagaacattataaaaagtaaaatagatataaaggggggctatcagaaaccccaaatctgtgatcttctcctgtttcaaattatcttaagctccttttt

SEQ ID NO: 4322 - DNA, 1429 bp, Homo sapiens
  misc_feature (2)..(2): n equals a,t,g, or c
  misc_feature (14)..(14): n equals a,t,g, or c
tngtttgggcgccngcagccaccggtccggaattcccgggtcgacccacgcgtccggtgagtgcgtcccttytttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcrtttttggaaagacttcctcgygacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaaaaaaaaaaaaaaaaaaaaaaaaaaaaaaagggcggccgc

SEQ ID NO: 4323 - DNA, 775 bp, Homo sapiens
  misc_feature (694)..(694): n equals a,t,g, or c
  misc_feature (737)..(737): n equals a,t,g, or c
ggggaaactgaaaaatacttgggcagaaagaaaatatcatcaaataacacctatttcttttcagctatagagatggctggatatcaaaagcaccacgggagctttgcaatttgctgcctcttttcagccctcagcttgactctcagttttcaagagggagaaaatgaatgtttcccagcattctctgtcctttgctccaaagaagagagcaggtgttggcttccaaaccttccgtattttcttattgctgttagggggatcaactgcatgtttcctgagggaaaagggtggctcactgacctacttgaaggcattctctcagtggaagctgggcaagagaatccagggatttcttttgcaggtttctgcgcagtgcccctgccatcaagctgcctaaaatgtgaatattgcttccctgcgtttcagaggtggtaatattggggcaagtggtggaggatctaaaaaaaaaatcatctttgtgctccctaccttgcccctggtatggattaaacagccaccaccctccttctcttataccctgggggcctcctgacaatacttccaattgctccattgattacttagattttttgggacacaaagggcccacgttgtgtcttcctgacaacacttttaagttgctctattgattacttagatttttggtggcaattaggagcttttcaggtaacantctttgctccatcggtaggctctgctggctcttggtcactgangaaacacctgacacagggctttagggaaagccttctat

SEQ ID NO: 4324 - DNA, 549 bp, Homo sapiens
  misc_feature (532)..(532): n equals a,t,g, or c
ctgatgttttacaaatcaccttttggtggcctcttgtcactgctgtctcccttcaagggttaaataagcytctctcacccattccttttcacacctgtgtcgtgtattattggcaggcctcagtcctcagggtgtcaaatggaactgatggatgccagacattgtggatatctgcaagtcctggttggtgaccagggacttgaagagtagactttcttctcaaacttatctttgtgctgttttccttccccagacctcatagtctggagcccatgtttccaggggtggaatttgattttcccagagaggagctgtgttcggcttctaggctgaggagctaagctgccgagcctctgccagccctctgtggattcgctcctgcattattcagcgcctttgctgacagagcaccatgttccactgctgagcagatcagggtgaatttccaagagggaacattgcagatggttttgcctttagggatggattttcttactcccaagtgactcacttctggtaaaattaaaaaaanaaaaaaagggcggccgc

SEQ ID NO: 4325 - DNA, 2197 bp, Homo sapiens
  misc_feature (1975)..(1975): n equals a,t,g, or c
  misc_feature (2006)..(2006): n equals a,t,g, or c
  misc_feature (2047)..(2047): n equals a,t,g, or c
  misc_feature (2133)..(2133): n equals a,t,g, or c
  misc_feature (2177)..(2177): n equals a,t,g, or c
gctctgtcactggtgccttctggaagatggcttccccttggggagcatttcctgcaaagactcacaagtttaaaataatttaggatatttctctgtacttgagagccaggataggatgagagttggtcctgccctgatgctgtaaggccactcctgtctcagaccctgaggtcctcaggagtggtttcccaagtactgttgtagttgtatggcaagatcactcttgattattttaggagctgattttacttttcctacctcttttaactgcttccaaaagatgaatctggccaagaagagcaggggctcattcactcatttactcactcattcctggtgcttgagtttattcctgaaggaagctgaccaagggttgagagaaaacaactttgatttttctcatgtctgccccagcaaacctcctttgtggactgattctccttctgtgcctggaagaaactgggataatcccaggacttttctggtcccttctaggtaattcagtgtcttccactaatgtggccccacacaggctgggcttgttgatagtataggtccagcaaaacagttaaaactctacatgtcttccgcatgtgaacctcttcccaacctcacctggtgctgtggcaggtgggaggctgggtgtcaggctggctgctgccccctgggttctgcccagctggtagctatggcttcaaccctycagtgggaggaacaagagggataagaggkaaggrcaggaraggttctgtatggctggcatggcagagagctggcacatgaggctggyaggaratccacagggctctgggggcattctcatggtctcctaagtgaccacactaccctggggtgtctctgccacaactggccaactcaggaggtgtatcctctccagctggtcccttacactcacttccttagccctaggtggccgtggtacctctagcctcttgccaaggtctgccctcacatctccaggaacccttctgggcaggatttaagacatcccaggccagtgttcaggcactatgaccccacctggtccacaggaaatgtgcacctttgatccactgggttagggttatttccacatgcagcctagttgcctactgggagctccaggagtcaacttttgccctttagatttcttgagtgtaagagggataccaggtctctgcccaccaccagcctcagaaggcacacagtaggcacttgcaggcctcgtgaaacccctcttggaatgaagtaaggagaaagctgcccatccctctcatggtacaggttgggtggggacagactgagagcactgcccccctctcccaaggaagccctcctgtcaaacttgagcttctctcatcttcaacacctcctctacctagatcacccagaatttcacatgggaacaaktggcacttcytgtcttggggcctcagctaaaattcagactggaaaagctycatattaacatcctgktctaatgcaagtaaaaaaagagctgctatggtctttgsttcttggwatttagagtctagtgggagaatattggctacttaatgcagtctcttccattttcaatatgtaactgaggcatccttctactgataacagccaaaacttcaagaaaaaatattttaagcctttaaaaatacatttgtgggctggtaggaaattaaggaataatcagagaccaaaaactaagtgaagctgagaacccagagataactttattaaaggagaatattaaacatatacttcacgcagaaggaagagaattccaggtggaagatttgagatgcaagggggaatgaaaaacaagaaggtggtgactatatgggtaaatcaaatcaaatcaaacaccttgtgtaaaataataatggtgatataagaattttaaaaagagaaataagtatatagtcataatatgatacaaatttgaagagggtgatgagttaaaaagttctaagattcttgngttaactttggaggatggttatctaatttgnaataaaattttcaggataatcatcaaccgtagaaatggggntgaaatttcaaactaatggaaagaaaaaagaatgagaaaatataatcaatcaaaagggaaaagactagaaagggaaaggaaaaaangaaacacaaaagaggtgggaaccaaaaagtcccaaatatatcantaactaccattaaaacataa

SEQ ID NO: 4326 - DNA, 403 bp, Homo sapiens
gaacctcttcccaacctcacctggtgctgtggcaggtgggaggctgggtgtcaggctggctgctgccccctgggttctgcccagctggtagctatggcttccaaccctccagtgggaggaacaagagggataagaggtaaggacaggagaggttctgtatggctggcatggcagagagctggcacatgaggctggcaggaaatccagagggctctgggggcattctcatggtctcctaagtgaccacactaccctggggtgtctctgccacaactggccaactcaggaggtgtatcctctccagctggtcccttacactcacttccttagccctaggtggccgtggtacctctagcctcttgccaaggtctgcctyacatcttcaggaacccttctgggcagc

SEQ ID NO: 4327 - DNA, 440 bp, Homo sapiens
  misc_feature (11)..(11): n equals a,t,g, or c
gattaaagtgnattactatatgctgtttacagaaaacacatctacactctaagggtacagaaaggatgaaagtaaaaggatgggaaagggtatactggggaaatataactgaaggaaatatgatgaatctatattaatgtaaaaaawttgattttggggtaaaargcatcactggagatagagagaatcactatgtamtgattaaacwattcatttcatcaagcagataatataattttgaattttattctttccataacataatttcaaaatctgtaaagcaaatattgacagaactataaggaagaatatataaattcatcatcagagagaaatattttaaatactgtaactcagtattttatagaagaagtaaataaaagccagtaaaggttatagaacatttgaacaatgcaaaaaaaaaaaaaaagggcggccgc

SEQ ID NO: 4328 - DNA, 1952 bp, Homo sapiens
  misc_feature (25)..(25): n equals a,t,g, or c
  misc_feature (39)..(39): n equals a,t,g, or c
atttaggtgacactatagaaggtancgcctgcaggtacncggtccggaattcccgggtcgacccacgcgtccgagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctgaccgggctgccctcgggcctcttccaggcctcagccaccctggacaccctggtattgaaagaaaaccagctggaggtcctggaggtctcgtggctacacggcctgaaagctctggggcatctggacctgtctgggaaccgcctccggaaactgccccccgggctgctggccaacttcaccctcctgcgcacccttgaccttggggagaaccagttggagaccttgccacctgacctcctgaggggtccgctgcaattagaacggctacatctagaaggcaacaaattgcaagtactgggaaaagatctcctcttgccgcagccggacctgcgctacctcttcctgaacggcaacaagctggccagggtggcagccggtgccttccagggcctgcggcagctggacatgctggacctctccaataactcactggccagcgtgcccgaggggctctgggcatccctagggcagccaaactgggacatgcgggatggcttcgacatctccggcaacccctggatctgtgaccagaacctgagcgacctctatcgttggcttcaggcccaaaaagacaagatgttttcccagaatgacacgcgctgtgctgggcctgaagccgtgaagggccagacgctcctggcagtggccaagtcccagtgagaccaggggcttgggttgagggtggggggtctggtagaacactgcaacccgcttaacaaataatcctgcctttggccgggtgcgggggctcacgcctgtaatcccagcactttgggaggcccaggtgggcggatcacgaggtcaggagatcgagaccatcttggctaacatggtgaaaccctgtctctactaaaaatataaaaaattagccaggcgtggtggtgggcacctgtagtcccagcaactcgggaggctgaggcaggagaatggcgtgaacttgggaggcggagcttgcggtgagccaagatcgtgccactgcactctagcctgggcgacagagcaagactgtctcaaaaaaattaaaattaaaattaaaaacaaataatcctgccttttacaggtgaaactcggggctgtccatagcggctgggaccccgtttcatccatccatgcttcctagaacacacgatgggctttccttacccatgcccaaggtgtgccctccgtctggaatgccgttccctgtttcccagatctcttgaactctgggttctcccagccccttgtccttccttccagctgagccctggccacactggggctgcctttctctgactctgtcttccccaagtcagggggctctctgagtgcagggtctgatgctgagtcccacttagcttggggtcagaaccaaggggtttaataaataacccttgaaaactgaaaagaaaaaaaaaaaaaaaaaaaagggcggccgctctagaggatccctcgaggggcccaagcttacgcgtgcatgcgacgtcatagctctctccctatagtgag

SEQ ID NO: 4329 - DNA, 1812 bp, Homo sapiens
ccacgcgtccgagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctgaccgggctgccctcgggcctcttccaggcctcagccaccctggacaccctggtattgaaagaaaaccagctggaggtcctggaggtctcgtggctacacggcctgaaagctctggggcatctggacctgtctgggaaccgcctccggaaactgccccccgggctgctggccaacttcaccctcctgcgcacccttgaccttggggagaaccagttggagaccttgccacctgacctcctgaggggtccgctgcaattagaacggctacatctagaaggcaacaaattgcaagtactgggaaaagatctcctcttgccgcagccggacctgcgctacctcttcctgaacggcaacaagctggccagggtggcagccggtgccttccagggcctgcggcagctggacatgctggacctctccaataactcactggccagcgtgcccgaggggctctgggcatccctagggcagccaaactgggacatgcgggatggcttcgacatctccggcaacccctggatctgtgaccagaacctgagcgacctctatcgttggcttcaggcccaaaaagacaagatgttttcccagaatgacacgcgctgtgctgggcctgaagccgtgaagggccagacgctcctggcagtggccaagtcccagtgagaccaggggcttgggttgagggtggggggtctggtagaacactgcaacccgcttaacaaataatcctgcctttggccgggtgcgggggctcacgcctgtaatcccagcactttgggaggcccaggtgggcggatcacgaggtcaggagatcgagaccatcttggctaacatggtgaaaccctgtctctactaaaaatataaaaaattagccaggcgtggtggtgggcacctgtagtcccagcaactcgggaggctgaggcaggagaatggcgtgaacttgggaggcggagcttgcggtgagccaagatcgtgccactgcactctagcctgggcgacagagcaagactgtctcaaaaaaattaaaattaaaattaaaaacaaataatcctgccttttacaggtgaaactcggggctgtccatagcggctgggaccccgtttcatccatccatgcttcctagaacacacgatgggctttccttacccatgcccaaggtgtgccctccgtctggaatgccgttccctgtttcccagatctcttgaactctgggttctcccagccccttgtccttccttccagctgagccctggccacactggggctgcctttctctgactctgtcttccccaagtcagggggctctctgagtgcagggtctgatgctgagtcccacttagcttggggtcagaaccaaggggtttaataaataacccttgaaaactgaaaagaaaaaaaaaaaaaaaaaaaagg

SEQ ID NO: 4330 - DNA, 3288 bp, Homo sapiens
ccacgcgtccggggaaaagggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttctttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaattaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatgggaggtagctgggggtacaagtggatgttgagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacagagatggtgtctacaattagagacatttctgacttcaccttagcctaagcaaactttatatactgagtaacatttgaaggttgcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgctttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaaaaaaaaaaaaaaaaaaaaaaaaaaaaaaaaaaaaaaaaaaaaa

SEQ ID NO: 4331 - DNA, 1080 bp, Homo sapiens
  misc_feature (1078)..(1079): n equals a,t,g, or c
gcggacgcgtgggctaggggcatagacttgtatttttatgttttggggatgggatggggttatcttctgttgtaaattaggtgggatatgaacacacttattttcctggtgagtaggacacagggagggtattgaactcaaaggagaaggagcctctatttcctgttgaggcttatactttctgacaaggaaactcccaaagggccaagatactttttggtcccatgatagtcaggttccagacttctttcttttctattgtatttgtatgtggaaagccattaatgaatttattttactccaagagatacacataaaagggaaaagggcatggttgggaggttgagcagtaagagaccattaatactaagtattttgcctgaaatgcttctttataattatttcagggaaggaataagataatctcagacttactggggtggggcttggggaatgtttggatgttgcycttttycttcttccttcttttttttttttttttttggtggtgttgtttggcatttttttcttttcctttttaaagaaaatgttttcaggaaacatgaacaaacatactgscaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaattaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgcaccataaacctgtaaaagggcatcgacagcttttcagataatccaggaatgttgagacatggctaagtttctagctgatacttagtcattccctcttgatattggtgggatggnna

SEQ ID NO: 4332 - DNA, 856 bp, Homo sapiens
  misc_feature (770)..(770): n equals a,t,g, or c
  misc_feature (772)..(772): n equals a,t,g, or c
  misc_feature (811)..(811): n equals a,t,g, or c
  misc_feature (829)..(829): n equals a,t,g, or c
ctattgaaggtacgcctgcaggcaccggtccggaattcccgggtcgacccacgcgtccggaaccaagtcccctgcatgagatggagtcccatctcagcacatggccctgccatccatcctgttgtttgttcttaattcttctctttccttcacaccctacatccatgaccaaaagtaaagcccgcctacctcacttggaaaattgctctcaaaacgacacctccaaaccactaggccaggccaggccaccatcatctcccaccagaacaacagacctcaccactggtcccacttccagtcctgcccctctaggtattctccatactgcagtcagagtgacacacttacacacacttaccctcatgggagaagagaaagctgtgttcgttgcaagggcccaagtggggaaccttggcttagtattcagaaaagccagaggtagtgrgtttccgaccctaggcagatgaccagcttgctttggaagtggctctcctgtctgccagagggctggtgagggaagctctcarggcaggaggctgytcccaggcctcctgcttctggaaggagagggatgtgcaccagccctgtagaacagccatgtctgtgggcccctctggcaggtgggcttaggacctccaaggggcgccttcatcgagttggggtggaggcagacttagcagccccatgagagttcatctttatgtgcatcatgcttgggtttttccttgctcccatttgcttttcctggctccaagaatgaccaaaccagngnttgcttttttaaattggcatattaaatatagccctttgnggcaagcttttacattcnggcagtaaactctagaaatggacattg

SEQ ID NO: 4333 - DNA, 1939 bp, Homo sapiens; identical to SEQ ID NO: 1383

SEQ ID NO: 4334 - DNA, 242 bp, Homo sapiens
  misc_feature (196)..(196): n equals a,t,g, or c
ggtctgcarggcttgtggggggcartgttctgcaaggggcargcggcgctggctttggctgcttgtggggtcctcttargctccggggggcctgcggcggcctgggargcagaccccgcgggcaggtgtggccgtgtcccgaccgcgcgaggacgaagttggcggaagcccctgtgcggtgccttccagcccggangaagctggcctgaagcccccaggcgttgccgaacctccccctgcca

SEQ ID NO: 4335 - DNA, 677 bp, Homo sapiens
  misc_feature (13)..(13): n equals a,t,g, or c
  misc_feature (16)..(16): n equals a,t,g, or c
  misc_feature (81)..(81): n equals a,t,g, or c
ggatagaattccnttngggatccagataacgtgctktggcccgggaggtggacmcagttttgctgtataaaagttaaaagngattttcaggaggaagcatctgtgggagtgagcyttggagggtataggattggggtggatgaaaatcaagmcaagggctgttagtaggtgtgcgggagctgaggtataggaacagggggacagtgtgctcttagccatgctttagctgattgaggggagagtttttgctgtcttctcagggtataacccaggtccattttgtcctttccctgtgactggtgacttctctgccctgaagttggctactctgcagagataaacattttcacctctggggaataagtagtagtgatgggaaatcctactaggtgttttgccatgctgctagcaccttgacttttcttatcaccttgagcaattacttaagttctctgtgccttggttgccttacctgtaaaatgggactattaccaatctctgacagttactatgctaattaaatgagattacctttttttttttttttttgaggtggagtttcgttcttgttgcccaggctggggtacagtgagctgagatcgtgccactgcatgccagccagggcgacagagaaagagttatctttttttttaaaaaaaaaaaaaaagggcggccgc

SEQ ID NO: 4336 - DNA, 1379 bp, Homo sapiens
gggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcatgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaagctggtggtttggcacctgcagccattccaaccttcaacgggccagtacttccggctccatcccacagcagcggcagaagcttaagaagggaatcttctggaagacctgcgggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacacttaaaaaaaaaaaaaaaaaaaaaaaaaaaaaaaaaaaaa

SEQ ID NO: 4337 - DNA, 560 bp, Homo sapiens
ccagctccaaattaaccctcactaaagggaacmaaagctggagctccaccgcggtggcggccgctctagaactagtggatcccccgggctgcaggaattcggcacgagctgaggctgagctgaggatctagtggtgagcagtaaatgttgataagtaaaggagtccagcttttatgcaaagcagtttatcccagccatctgtggtcctttctggtactgctattcacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaaaaaaaaaaaaaaaaaaaaaaaaa

SEQ ID NO: 4338 - DNA, 496 bp, Homo sapiens
aattcggctttcgagcggccgcccgggcaggtcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatcaaaaaataaaaataatttaaaaaaaaaaaaaaaaaaaaaaaaaaarrgggsggcccccc

SEQ ID NO: 4339 - DNA, 857 bp, Homo sapiens
  misc_feature (834)..(834): n equals a,t,g, or c
gcccacgctccgctctgctgactggaacctggttctgtgctggagctgtggctgggtgtggtttgctgagaagcccccggggytgtwgccacctwgcttctgccccttgttcctgcagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcaaaaaaaaaaaaaaaaaaaaaaaaaaaaaaaaaaaaaaaaaaaaaaaaaaaaaaanaaaaaaataataaaaaaaaaaat

SEQ ID NO: 4340 - DNA, 2036 bp, Homo sapiens
cccacgcgtccgcccacgcgtccgcccacgcgtccgggctgactacttggaagcttgtgtagtatctgtgttgcagatccatgtgacccagccccctggggatatcctggtgttcctgacaggacaggaggagattgwggctgcctgtragatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagaraaagtgatatgtgaaattctatctcatatagtcagttaaactttattatttacaagttaaattacacagcagctttacacagcatgagatggaaaggaaggaaggagagaaacgaggagaggaagctggctcctgagattcttggctgcctccacctccttctcttgggcgtagcagtcttcagtgctgcctccactccaaggtcaaggatcagggcttggaacacaggtttaagtcaggttctggctctgacagccccagggccaccagggctcccactagcagcttcttcacaggcgttggaggtgagtgtgaaggcatcagctgcagggagaaaggttaatgccagttgggggaggcacacaaatgttctaccctttaccccacccagccctacctaggactcamtttatctagacgatggcgacaaatgaggccactggaattcaggtagaaagtggagtaggcatcataggtcctggggaatagagggaggcttactgagggagaaggtgactggt

SEQ ID NO: 4341 - DNA, 1379 bp, Homo sapiens; identical to SEQ ID NO: 3981

SEQ ID NO: 4342 - DNA, 2547 bp, Homo sapiens
  misc_feature (2537)..(2537): n equals a,t,g, or c
gcccacgcgttcgcccacgcgtccgcggacgcgtgggttaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgktgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttgaaaaaaaaaaaaaaaaaaaaaaaaaaaaaaaaaaaaaaaaaaaaaaaaaaaaaatangggggggggg

SEQ ID NO: 4343 - DNA, 1176 bp, Homo sapiens
ccacgcgtccgaggacaaaaaacaggccttttaaaattctgttcagaaccagaagatgatcaagaaagggaaatgcccactagcagcttctactgtaaggttagagctgacagagaaagaactccttaactactatttgcttcattctctacaaaggaaactagagaagtgggttgatgtaatagaaagaacatgtgtttgtggggccaggcaaacctgggtttaattctgtttcaacactgcttaacaaaatttatgggaggctattgttttggattgggctcctgcaccaggcccctccgggaccaaaccaaaatggagtcactcatactaaaactccaggtcactgaaccaaaactaagttgttttatctgaccttccaagaaatcaggagggagaaaacaaccaaatctccaaacaggccagttttaatcagcgtgataaggaagtcctctcttttttaaccctataaagaaagtaactttttgaaatgatcaatacactttgtattccttagttctgctttctttagcccctttctgcctataaagcccacttcctctgctcaacttactgaagcagtattccattttatagaatgagatgctgcccaattctggaatcactaataaaagccaattagatctttacatttgttgaaattttgtctttgacaacattactagttatattattctgggtatccttttccccatctgtaaaatggacatagcgatatccttcccatcagatttttctcattaatagaagtaatacattcaaaacactgagccaggctcacaccagtgagcaacttgttaatattactcagaagcatattatagatattgacagaaagcaatactgttcctaattaggggaagaaattctaagagagtacctaagagtttgaatttagattataacatttgctctgagtattttacattacagcctttggggggaaaagtacaaatgagatctgagaacagtggtactcatctttgaggaattatggaaaacgtaatagaacactaaacatgggaaaacatcggccttcaggttgaaaagtggaaatctcaatccctgaatttttttttttttttactaagtaacttttttgcccattggtgtcatttaaccaaaagaagaagaaattccaaaaaaaaaaaaaaa

SEQ ID NO: 4344 - DNA, 775 bp, Homo sapiens
  misc_feature (747)..(747): n equals a,t,g, or c
aattcggcacgagaactagtcagtcctatgcttgaaacgagatgccccttcaatttttgagacttactatccaagttatggtttcagatctaacacttcttgtaatcagtgtgcaataaatgatgaaatgacattcctggaaatcactaagcgatttacttactctttttctagctcaggctcagcagactttttctgtaaagggccaggtagtaaatgtttgaggctttatgggccacagactatctctgttgcctcttcttatttgtgtctttttttcgaccacttcaaaaatgtaaaaatcattcttagctcacaagccataaaaaacagactacaggccagatttggcccatgggccatagtttgccaacccgttttaaacactgaggttcgagtctcccattaatggtggcattctctgggataacgcctaaaacattggagttttaattaagttgtattaagtcaccattatcgaaaagatgtattakaaattatgacccgtacagactgggttaaaatgtggcttgtgtgkcttctgcagcttgcacctgcctgcccgccaggtgattttgcaggcacaatctgagggctagaacctggggctttctctgcctctgkctagtcctgctggattgtaagctccatgagggcaggarcttgcttgtkgttkgctactatgttcccagcacacagaacactgctgggaaatatgttcggggctggttctcatttgtcttgatngcatccagatttttccaagttattggct

SEQ ID NO: 4345 - DNA, 1455 bp, Homo sapiens
  misc_feature (141)..(141): n equals a,t,g, or c
  misc_feature (218)..(218): n equals a,t,g, or c
  misc_feature (578)..(578): n equals a,t,g, or c
  misc_feature (1359)..(1359): n equals a,t,g, or c
  misc_feature (1421)..(1421): n equals a,t,g, or c
cgtagcttctttcggggtttagggccaaagacccattagaaattatgacccgtacagactgggttaaaatgtggtttgtgtttcttctgcagcttgcacctgcctgcccgcccaggtgattttgcaggcacaatctgaggngctagaacctggggctttctctgcctctgtctagtcctgctggattgtaagctccatgagggcaggagcttgcttgntgtttgctactatgttcccagcacacagracactgctgggaaatatgttcggggctggttctcatttgtcttgatagcatccagatttttccaagtagttggctttccgtatgtccattttactctctgtccatatatatacacaacattacatagtactcatgcaccagttaccattcccagggattatgtaattcctcagtacagccctgtgtggtcttgtgtctccatcttacagatgagaggccatgatcaggcagctagtttgtagaaagctgccagggtttgcacccagccattatggctacactgctgggactcttagcacccctaaagggaagcacttgagtggctcgttgnttmtgtcaccatcaggcttccatctcccagcagaystcagaggatctctggttttcacttctgtaacttttcaaagctctatcaccctttggagaatataagaacattctgagacagacatacagatttgtcaaaactgccgagtttgtccaaactcactgaactgtacccttaaaatgggtgtgttctattatatataagttgtatctcagtaaagttgatttttaaaattgttctcatcacaaagtcaaatggatttggaaagctttaattagagaagaaaaaaagaaaccttttttaatcagaagagkccagcctcttccaacaaaagttgtaattgctttgttttccaagctagctatttaaaaatcaggagttctggccaggcatggtggctcacgcctgtaatcccagcactttgggaggcccgaggcaggcagatcacgaggtcaggagattgagaccatcctggctaacacgacgaagccccgtctctactaaaaaatacaaaaaattagctgggcatggtggcgggcgcctgtagtcccagctactcaggaggctgaggcaggagaatggtgtgaacccgggaggcggagcttgcagtgagccaagatctcgccactgcactccagcctgggtgacagagcaagactccatctcaaaaaaaaaaaaaaaaaaaactcgagggggggcccggtacccaattcgccctatagtgagtcgtattacaattcactggccgtcgttttacaacgtcgtgacttgggaaaaccctggncgttacccaacttaatcgccttgcagcacatccccctttcgccagctggcgtaatagcgaanaggcccccgcaccgatcgcccttcccaacagttg

SEQ ID NO: 4346 - DNA, 1663 bp, Homo sapiens
  misc_feature (975)..(975): n equals a,t,g, or c
aattcggcagagttttctgatcagactctttttattgttttgttttttataaacaagtctcaggtggaaaaagaaagaaagggaggagctagctctctgccttctcagccaattgaaatcgtggaaaccaatgggcttcagctagccccactcatcactgctgggggggaaaagacatccctactccccttccccgtggcactcatgatattctcaatgccccaacaagggtcatcttggttcctctcggcgtttctgtcctggcctttggctctggctccggctctgactccgactccggctccggccagggccccgggagcccctagagctgctggagcccctggaagagttgctgccggccgtggaacatgtgctggtgccctggccccgggacaggaagcttggtctgctgtatgggagccaggcctcttcatctgggtggagcacccgctgggctgccaggggcacggcctggaccgctttcctctccccactgcgctcccgctccagggaggacatgctgcctgctgccctcagctctagggcccagctcgcctcttcctctggcggtggcaagggtggtgggggcaagtccccaggactgttctccctcctgtagggaagagccttgggtttcttccggaatcgagcacggggtccttgaagtgggggagtcatctccccattcccctgccaggttctgcctggggcactgctggctgtgctaggggcaggactggggctgaggtggggtgaggctgcagggccagcacccaagccagcaggcctcgcttcacggatgcccagcatgggctgggatacactgagaggggaactcggcccaaggggcaccytcctgggcatctgatggagatggggcatgtcagttgggggctggggagggtcaggaggtgagggtgtaagagtggctgtggactgctgtccataggaaggtgtgggagagggggtttnccttcgggatggggtgaccaggcaccctccactggagctgggctccgtcaggtgacttctctcaggcattggcgggcaccactcctctggctctgagctgccctccagctcctcctccggcccttctaggcagctcagttcacaagaaggaggaggtgggggcagggcttctggccagttcagagagggcatctgcacaggtttccccagaagcttcactttgcctcccttggctccactgtccccctggctccactctggaggagcgtactggctccagggacccagatctcctgagggatgttgggggaagcccccatggaaggtctgcagctcctcccccgctgggtcaatggtgctatagacaggaccctcgccaggggcggccgtgcccctggccgtctgagctagatacagggagattcccgcttcgttgtaatatctgtcgtccgggtcaggattgctagggcagcagcttcccctgggttcctgggccgaggggcttcgagatgggtggggccacgaatctgccagccatgagtagggggctttccgtcctcgaacttgccccttctttatggagatggttgcaaagcctggcctcctcgtggcgtcttagaggcaaacgtcatccagatcccgccccgtcttggcccgcagccctccctagtcctggcagctcctcgag

SEQ ID NO: 4347 - DNA, 792 bp, Homo sapiens
ggcacgagcgcgtttgccagtacaacactgatgatgtttttagccagggtgccgttccttttcactattgtgccattctctgttctacggtccatgttgtcaaaagtggttcgttcgactgaacaaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacaggtgactgtgatttaaacaaacaaaaaaaatctatgaatgcacatatcatataccatgacttctgaagactataaatgaattccacaatcagtgcttcactgagaaccaattttacctatcttttcttctaaactgaacagtcagagagacagctcctggctttagcttcttgtggtaccacgcactttgagcactttgtgcgtatcatgcaatatacttgcaatacacagaacaaatttcaaatacgcctcacttttagacttagaagagaaacattaaaacttaagggtgtaaggagggatcaagaaacttgataaggtcaaaagcaataatctctctgacatattccaggctcttacactgagaccaaagagaaatctttacctcagtttcttcatcagcagaataaaaaaaaaaaaaaaaaaaa

SEQ ID NO: 4348 - DNA, 2353 bp, Homo sapiens
ttgctttgcctatatagttgatcagtgtaaagaacacaaacaaaaaacaattcgaatagctatcattgactttctacttggacttgttactggactaacaggactgtcatctggctattttattagagagctaggttttgagtggtcgtttctaattattgctgtgtctcttgctgttaatttgatctatattttattttttctcggagatccagtgaaagagtgttcatctcagaatgttactatgtcatgtagtgaaggcttcaaaaacctattttaccgaacttacatgctttttaagaatgcttctggtaagagacgatttttgctctgkttgktactttttacagtaatcacttatttttttgkggtaattggcattgccccaatttttatcctttatgaattggattcaccactctgctggaatgaagtttttataggttatggatcagctttgggtagtgcctcttttttgactagtttcctaggaatatggcttttttcttattgtatggaagatattcatatggccttcattgggatttttaccacgatgacaggaatggctatgaccgcgtttgccagtacaacactgatgatgtttttagccagggtgccgttccttttcactattgtgccattctctgttctacggtccatgttgtcaaaagtggttcgttcgactgaacaaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacaggtgactgtgatttaaacaaacaaaaaaaatctatsaatgcacatatcatataccatgacttctgaagactatmaatgaattccacaatcagtgcttcactgagaaccaattttmcctatcttttcttctaaactgaacagtcagagagmcagctcctggctttagcttcttgtggtaccacgcactttgacactttgtgcgtatcatgcaatatacttgcaatacacagaacmaatttcaaatacgcctcacttttagacttagaagagaaacattaaaacttaagggtgtaaggagggatcaagaaacttgataaggtcaaaagcaataatctctctgacatattccaggctcttacactgagaccaaagagaaatctttacctcagtttcttcatcagcagaatgggtttctggcctctctcagggataattttgaaggcataatgaaaattatgatgaatcactcattggtaggaaaataatgatataagtttcaaatatgtatrattttacctatacttggtaatgctttgttttatagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaaaaaactgaatgaacagctaatactggtataaagtaactaatgtttggagccaacatttgttccttgtgtcagcaaaaggatattcacattccatgatccctggctgagaattctgcctctagtctttcttacccagctgttgtctatccttgktcaattataaatactgctaagggcatttttaaaatacgatcttgtastccttaaatttgaatccgtcagcacggtcactcataggaaaatgatcaaacaagcaagccagtcatgatttgactccttcccatctcatttcttactgccttacgctcatcctgaggtccaccttggtctctaaaaacaccatgtgttctcatgcctccatgtcttttcacacactgttccatttgctcttcctcccacattacattgaaactttcaagcctcagtcgaaacattgcttcttctggatagcagccttcttgacatccctcctcactccccagtccctacagggcttccatagctctttrtgtgcacttcgatcccagcattttccatcgacttgtaattgtttctgctacctgacaatcatcgccttgagtactgggacaacctttgattactcattatatcctcaataaatatttgttgaactaaa

SEQ ID NO: 4349 - DNA, 774 bp, Homo sapiens
  misc_feature (773)..(773): n equals a,t,g, or c
tttaaagatgaagaaatgacaagggagggagatgagatggaaaggtgtttggaagagataaggggtctragaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagataaaaaaaaaaaaaaaaaana

SEQ ID NO: 4350 - DNA, 1683 bp, Homo sapiens
ggcacgaggagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacagaaaaccatgttctgcttgtttgaaaatgattgtaaatgcaaagccttaagagtaatgatcagatctatgtcaaggtcagtgccttgagctataaatggcagaacttctagaagaaatggatcatgtggctagaaacctctcggcctgcaacaagtatttcgagcaggattactgggagcagctaagatgcctagatgaaaggtttaccatcactgctggttaggaaatggattatgagaactcgaacagagggaaggtgaaatgcaaccggaggaaacactctgatatgaggtttgaggccttcaaaattgctttgcagcataagccacagtgagtcaggagtaccagggagtggatagaatgtttatttgtttaactgagactttttagttcatcaattattttgaagggtagaacactctgtgggctctctttctatttccttctgggtacaatcacaaaaaaaaaatctctcctagctgaaattacatgcagtactagcaaaggggtctctttgttataaactgttcattaattgacgaacatttgtgtacttaactatgtataaggcatctcatcgttcaatttcaaatacaaattaaaatattttttcacatttgttatcctgttatgttttctcttttacaaattgtctgttcgtatctttttgtctctctttaggccttattcttgtcaattcatatgtgctctaatgaattgaaatattttctgtatattaaacattactaacctttcctctgtcacactgattgaaaaatgatctatttagtttgttgttttgtctttaattttgtaagctttaaaaagttaatattgcccttcagacaccatcccaacatcacataagaattttttcatgttataaattctttgtggacatatttgataactgttttattatgaggaggaccataattaattcaaccattcccctattttggtcatttaggtttttgggtttgggttttttgtttgtttaacgtctttgcttgctattttaaagaatgctgcactaaatgtgaatgcttgagatttcttctctgtatttagaatattttcctagaatggattctcagaagaattctcagtctgtggagaggaacatttttaatgcatggaagagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgtaaaaaaaaaaaaaaaaaaaaaaa

SEQ ID NO: 4351 - DNA, 982 bp, Homo sapiens
  misc_feature (1)..(1): n equals a,t,g, or c
  misc_feature (5)..(5): n equals a,t,g, or c
  misc_feature (28)..(28): n equals a,t,g, or c
  misc_feature (38)..(38): n equals a,t,g, or c
  misc_feature (57)..(57): n equals a,t,g, or c
  misc_feature (318)..(318): n equals a,t,g, or c
nggcntctttcccttaaaagaggtctcnggccccatancacaaaaacataatttgangaacatttgtgtacttaactatgtataaggcatctcatcgttcaatttcaaatacaaattaaaatattttttcacatttgttatcctgttatgttttctcttttacaaattgtctgttcgtatctttttgtctctctttaggccttattcttgtcaattcatatgtgctctaatgaattgaaatattttctgtatattaaacattactamcctttcctctgtcacactgattgaaaaatgaycwatttagttkgttgtttngtctttaattttgtaagctttaaaaagttaatattgcccttcagacaccatcccaacatcacataagaattttttcatgttataaattctttgtggacatatttgataactgttttattatgaggaggaccataattaattcaaccattcccctattttggtcatttaggtttttgggtttgggttttttgtttgtttaacgtctttgcttgctattttaaagaatgctgcactaaatgtgaatgcttgagatttcttctctgtatttagaatattttcctagaatggattctcagaagaattctcagtctgtggagaggaacatttttaatgcatggaagagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttaaaaaaaaaaaaaaaaaaaaaaactc

SEQ ID NO: 4352 - DNA, 541 bp, Homo sapiens
  misc_feature (420)..(420): n equals a,t,g, or c
  misc_feature (528)..(528): n equals a,t,g, or c
gctcagagatgcctcactcttccttgtaccctcctcccttcttcaaaatgaaattgattattagggtttggtttattatttcattgttctttgtgcaagggcgaacaaatccatgtatactcctgccctacacacacccacaggtagcgctccatctgctattctgtgccttgcttttttcagacgcgttaggaaaggccacatcagtcatgacatacacaggcttctttactcacagcactcattgtcgctttcatatttcttgctttagtctgagttttttaattctataagtaaaaacattttttaaatccagaattcaaaagtgatcataaaagttattcctccttttatcatatactctcagccgtttatgtggagtaggagtgtgagtgtgtagccttccagacccttctgtgntacagaacagaggaatttcttattgaaatttaactttgaattgktatactcgtaattttcttagttactatgctaatatctcawtatttaccggatcctagacatcanaccaaaaactgat

SEQ ID NO: 4353 - DNA, 2183 bp, Homo sapiens
gatctccccagagcaaagcgtcggagtcctcctcctccttctcctcctcctcctcctcctsctccagccgcccakgytcccccgccacccgtcagactcctccttcgaccgctcccggcgcggggccttccaggcgacaaggaccgagtaccctccggccggagccacgcagccgcggcttccggagccctcggggcggcggactggctcgcggtgcagattcttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgattttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaatgtttgtggtgttacttgatgtttacaatgtaacatgtaacattcaaatgtatcaaatgaggcatctttaccaaacaactaaatcttttgagctctcagtttggagacttcttttgtgtaatgccagatttcctaaataacagtgtcagcattgctcagatttaatcaaggctcagaaatggaaggactcgtgtacaactacattcaagatattctatgccgtcatgaaatgacaaatgtgtacattacttttagaatgctccaaactctagaatgaataggtgacagctttatattcattttctaatcagaatgacccccagagacaatttccaaattgtgggaagaatgacaccctgtaccatttcaccaagcttcaggccaacgtttgatgtccggagggaagcgtggcctattaactatcgaatagcctgcaagttagaaacaatccagcccaatattgagcacaacctttcaaaatctggttcattttaatttcgtaactcataagcagtgctagaatgagcacatttaagtaataattggcataattttaaatctcattgtgtgtacagatccttaacaccaatatggaatatgatgttaaatactatgcgtcataatcccagcattttgagaggccaaggcaggaggtttgcttgagcccaagagttcgagaccagcctggacaacatagccccatttacaaaaaaaaaaaaaaaaaactc

SEQ ID NO: 4354 - DNA, 596 bp, Homo sapiens
  misc_feature (480)..(480): n equals a,t,g, or c
  misc_feature (519)..(519): n equals a,t,g, or c
  misc_feature (547)..(547): n equals a,t,g, or c
  misc_feature (571)..(571): n equals a,t,g, or c
  misc_feature (582)..(582): n equals a,t,g, or c
gttagaataaggtggattgggaatttagtcacagttttataataataagtcatgtgtctaatttaatgtattggggaatttttttttccatattaaattttctagcattcttcagtctggttctgatcagtgtattattgtggacaggaatggtagtgtttaggagcttggaccctggagcggaactggttggatttgaatcccatctctatcactgctgtgtgacctcaggcaacttacctaactttcctggccctcagttttcctacatagaaaatgggaataataaaagtatctgcttcataggattattacgrgaattcgctaactcaatatatgcaaatctgttggaccagtgcttagcacataacagtcaataaaggttgagtgtcagcttttattaacagtaataaaattggctttctctccagtcagctaaattaattaggattttactttattcttccagttttataggancaatacccaaacctacctgagtttttgcgaataacttantgacagcaataatcaaaataacccagtnaaaatcttaccagccaatagcagnaccctaccagnaaattattttcttc

SEQ ID NO: 4355 - DNA, 554 bp, Homo sapiens
  misc_feature (478)..(478): n equals a,t,g, or c
  misc_feature (548)..(548): n equals a,t,g, or c
gttcagagtctcaggtgctgcttggcaggaaaatgcagggcaggaggggctgggcctcagctcgaggctcccaggtgcagccccccactccactgcagggcccaggggggccaagaacagccacaacaacaacaaaagccaaactgggaacggaatcgtggaaaaaaccctcataggcttttgggaacttacaaagaaatgcccacatccattctactaacatggcatctactaacgtggcatctactaggatgccacaaaacagacaaatccttccacgtaaggctggacacgtgtcagggcggtgtctcaaagctgggccacaggcagcatccacggccaggccactgggtggaggagacggtgctggggagkacccggagggaggggccggggctgttcccttaggcagaacggctcacctgtgtgtgcgcacacaggattgtggggacacaagatgcccccttcattcatcagntacttggattctttggatgaaacacctgccgataaaatgtgaaaaagggggcatttcctaaagtactttnaaaaaa

SEQ ID NO: 4356 - DNA, 417 bp, Homo sapiens
  misc_feature (387)..(387): n equals a,t,g, or c
  misc_feature (406)..(407): n equals a,t,g, or c
ggtcaaatgtacgtaagcaaagaagagagcaccaggatataaaactgccacagcagcttggaagacagatgattcagattttggggactttcttttgcgtgttacatagatttgtttgtcatcatgcagttaagcaggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaanccggcagggatttagcacnngatacaagat

SEQ ID NO: 4357 - DNA, 846 bp, Homo sapiens
ggagtttttttttcattttagtttatattaaataacaaatatttattcctgtgaatcagtagtttacacagataatattgagaggctttcttgggaatttgaaaggagtcttcaaatcatcctttccctcagagatgaaaaaatattttaaaaaaattactgtcttgtatatttgatattttgaaaatggcagggaatcaacaatttgttaatctgttgttaagatcagttatacattcagtggcatacttcttgtcttagaaattggttgaaattaatattgctagtgaaagtgtggaaatagraacagttgaaaggaagacaaatgagaagtggaccttgcttctcatgaggatgctgcagaactagagtggttgcccagcaggatgaaaatctcaattaattgcttgacagagaattaaaacaaaggcaagtggtgcttttaaaaaagataaaaataggtgaatataaagttgaaaggaggccaggtacagtggctcacacctgtaatcccagcactgtgggagcccaaggtgggtggatggcctgaggtcaggagtttgagaccagcctggacaacatggtgaaacgctgtctctactaaaaacacaaaaattacttgggcgtggtggcatacgcctgtaatcacagctactccagaggctgaggcaggagaatcacttgaacctggaaggtagaggttgcagtgagccgagatcgcgyccattacactccagcctgggtgacaagagcaagactatgtttccaaaaaaaaaaaagcaactgaatattggatagagaggagaaaaagggcaatgtatcaaaaaaaaaaaaaaaaaactcgag

SEQ ID NO: 4358 - DNA, 739 bp, Homo sapiens
  misc_feature (230)..(230): n equals a,t,g, or c
acaatacatgcatcatatcttttgactttgaaggatatctcatgtcaaaggaatcaagttatgatttatagaggattcagctggaataccttgtgggtgctggctgagggtggcaaaacgcctaccgagacatgaaggttttagccactagttttgtccttgggagcctggggttggccttctacctgcctttggtggtgactacacctaaaacactggccatccctgangaagctgcaagaagctgtggggaaagttatcatcaatgccacaacctgtactgtcacctgtggccttggctataaggaggagaccgtctgtgaggtgggccctgatggagtgagaaggaaatgtcagactcggcgcttagaatgtctgaccaactggatctgtgggatgctccatttcaccattctcattggcaaggaatttgagcttagctgtctgagttcagacatcttggagtttggacaggaagctttccggttcacctgkakacttgctcgaggtgtcatctccactgacgatgaggtcttcaaaccctttcaagccaactcccactttgtgaagtttaaatatgctcaggagtatgactctgggacatatcgctgtgatgtgcagctggtaaaaaacttgagactcgtcaagaggctctattttgggttgagggtccttcctcctaacttggtgaatctgaatttccatcagtcacttactgaggatcaggactaatagagaa

SEQ ID NO: 4359 - DNA, 737 bp, Homo sapiens
  misc_feature (587)..(587): n equals a,t,g, or c
  misc_feature (677)..(677): n equals a,t,g, or c
  misc_feature (701)..(701): n equals a,t,g, or c
  misc_feature (709)..(709): n equals a,t,g, or c
  misc_feature (734)..(734): n equals a,t,g, or c
  misc_feature (737)..(737): n equals a,t,g, or c
gcctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacattgactcatttgagtggctgagtacattctacatgtatagtattatgctgttttctttaagccattttgaggagcacaataaactggaaaaatgatttaccaaatatatggaattatatgtagtctgtttccttaatcctgatgctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtatttgctttatcccctctacactgcattgctgtagtgggcactccagagtgtgaatgttgggnagtggattttactttttggtggcaaatgcgctgatccggaatccagctaatggaaaaccattaaaaaaaaaaattcaactattgtccttnacaccccacagggaaaaccccaangggaactnaatgggcaattaaaatttttaaggntgn

SEQ ID NO: 4360 - DNA, 2890 bp, Homo sapiens
  misc_feature (1433)..(1433): n equals a,t,g, or c
cttttatgccttttggaaccttgtatctttagkgkttattkygttttcyccattaagtcatctggctccaaacagcagttttaacctcattcgtctytgtattttgctttatcccctctacactgcattgctgtagtgggcactcagagtgtgaatgttggtagtggatttttactttttgttggcaaattgcgctgatctgattccagctatggaaaacattaaaaaaaaaattcaacattgtctttacactcacaggaaatcctaggtaactattgtcattaatttttagatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggwgctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcakatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctnccccgcagagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaaraaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtcyccrcgttgtggcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgttgtgcacacagtgcagcctggatcctgtcgatctttacttgtggcggagctaatggtcacattgatagttgattacactgtggcacgaattaatgcagaacactgttattaataaaggaagtaaagggctgcaagatttgagagctgcaacaaaaaaaaaaaaaaaa

SEQ ID NO: 4361 - DNA, 1539 bp, Homo sapiens
gaattcggcacgagtatcactgcatatttttacccttatttttgctccttacagcaagattagtaggttataaaaatttaaatttaaacaaaattatttcatgacaaaatgggaaacttcacatcatacttatttttgtttgccttttcaggcatcatattagcttttataaaaaatggtcttgctgctgaaattgtacttattttatcagaggctgggtgcagtcaagacaaaagtaaaatggtttacctgagcccaggggagggaaaattgattaagatatcatatttttgtttggtttggttttgctttttcctcttactttaattgaaatactctgaattcccctcaggaaacagagagcatgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaacaaaaaaaaaaaaaaaaaactcga

SEQ ID NO: 4362 - DNA, 2632 bp, Homo sapiens
  misc_feature (67)..(67): n equals a,t,g, or c
  misc_feature (2620)..(2620): n equals a,t,g, or c
tcccagctctcaggacaagggccctgggcgatcttttaaaaaagccgattgggtgtctttctaaaantacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggaraatctgtccagggtgctttgatccttgcagarctgctttcagcagtgaaacgctcactggctcgaaccctggtcatcatagtcagtctgggatatggcatcgtcaagccacgcctggagtcactcttcataaggttgtagtagcagragccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaactcgatcggcacgagggggggcccggtacccaattcgccctatgggantcgaatgagacc

SEQ ID NO: 4363 - DNA, 2143 bp, Homo sapiens
  misc_feature (2058)..(2058): n equals a,t,g, or c
  misc_feature (2080)..(2080): n equals a,t,g, or c
  misc_feature (2115)..(2115): n equals a,t,g, or c
  misc_feature (2132)..(2132): n equals a,t,g, or c
tcgacccacgcgtccggttgaattccttgacctgcaaacacatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgatttttaaaaaagtttcctagggaagtatctctgagggaacaggcaatctgaaggaactgactatattctccatggctaagtccattaggccaaaagnctgggtgggtattggttgtcangctgtctattggcatattaaaaacgtaggccgganggaataattaggttgtnatgccggcggg

SEQ ID NO: 4364 - DNA, 1362 bp, Homo sapiens
ggcacgagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgacaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttaaaaaaaaaaaaaaaaaaaaaaaaaaaaaaa

SEQ ID NO: 4365 - DNA, 1349 bp, Homo sapiens
ctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttaaaaaaaaaaaaaaaaaaaaaaaaaaaaaaa

SEQ ID NO: 4366 - DNA, 604 bp, Homo sapiens
  misc_feature (584)..(584): n equals a,t,g, or c
  misc_feature (595)..(595): n equals a,t,g, or c
gaattcggcacgaggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgaacaaggaagtgacatgtaagagagagaagtgccccgtgctgtcccgagactgtgccctggccatcaagcagaggggagcctgttgtgaacaktgcaaaggttgcacctatgaaggaaatacctataacagctccttcaaatggcagagcccggctgagccttgtgttctacgccagtgccaggarggtgttgtcacagagtctggggtgcgctgtgttgktcattgtaaaaamcctttggagcatctgggaatgtgctgccccacatgtccaggctgtgtgtttgagggtgtgcagtatcaagaangggaggaattncagccagaa

SEQ ID NO: 4367 - DNA, 854 bp, Homo sapiens
  misc_feature (23)..(23): n equals a,t,g, or c
  misc_feature (26)..(26): n equals a,t,g, or c
  misc_feature (37)..(37): n equals a,t,g, or c
  misc_feature (50)..(50): n equals a,t,g, or c
gagtggggaaaatggtggttccnccngggagaagggnccccatttatccnggggggcatttccaggtttcccaaagaaaggaatgtatgcctgggaaaagaacagcaggagattggtgacccggccctaaatggtgcatgaaaaagcgagtgataggctgttagaacgtattaggtcatgggctaacattattcccaaaattgattggctggttgccaagaaatatatatttgtcactagggcataaccgaagaatcaagtgatttcttgccatccttgcgtagtcctcaagtcttctaatcatctatgtgtgtatgatggatgtgaccatttatatgtcatgtgttgaaattaaagggtgtctggatgccatgttaattttattgagcatgagaaagtatttgaagaaactgttgcacaacatatgatgaaattttgatttctctgaatctcagagtaatttaagatgggcaaatccaatgagttgatgtaacccatctacattttgtggctatttcatgtataaaatgaaaggctttagttatttctagaggagtcccatccaacactatttggcgactgttaatatgttataattattagacagtggaaaagcctttattgactaattgatttaacctcagtccaaagaacagtctctatacttgccctcatttactgataggctgctactagttaccatttgattgtcttgactttcgtcttcagttgaattggtgaaaacatcaacaaaaacaaaacccactgtgtcttaaaataaaatgttctgcattgtagtcaataaagggcttaagatgtaaaagcaaaaaaaaaaaaaaaaaaaaaaaactcga

SEQ ID NO: 4368 - DNA, 814 bp, Homo sapiens
  misc_feature (341)..(341): n equals a,t,g, or c
  misc_feature (354)..(354): n equals a,t,g, or c
  misc_feature (804)..(804): n equals a,t,g, or c
aaggggaggaatttcagccagaaggaagcaaatgtaccaagtgttcctgcactggaggcaggacacaatgtgtgagagaagtctgtcccattctctcctgtccccagcaccttagtcacatacccccaggacagtgctgccccaaatgtttgggtcagaggaaagtgtttgacctcccttttgggagctgcctctttcgaagtgatgtttatgacaatggatcctcatttctgtacgataactgcacagcttgtacctgcagggactctactgtggtttgcaagaggaagtgctcccaccctggtggctgtgaccaaggccaggagggctgttgtgaarantgcctcctacgantgcccccagaagacatcaaagtatgcaaatttggcaacaagattttccaggatggagagatgtggtcctctatcaattgtaccatctgtgcttgtgtgaaaggcaggacggagtgtcscaataagcagtgcattcccatcagtagctgcccacagggcaaaattctcaacagaaaaggatgctgtcctatttgcactgaaaagcccggcgtttgcacggtgtttggagatccccactacaacacttttgacggtcggacatttaactttcaggggacgtgtcagtacgttttgacaaaagactgctcctcccctgcctcgcccttccaggtgctggtgaagaacgacgcccgccggacacgctccttctcgtggaccaagtcggtggarctggtgctgggcgaracagggtcagcctgcagcagcacctcaccgtgcgctggtacggctngcgcatcgct

SEQ ID NO: 4369 - DNA, 2505 bp, Homo sapiens
cttatagtgatgaggtacctctttgccttcctcaatcatctatcacagtacagcgatgagaatatgatggaccctataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacasccatacagtgagcacggtacattggaggaagtggaccaagatgctggtacagagccccacacaagtgaagatgaatgtgagccaatagaagcaatagccaagtttgactatgttgggcggtccgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccwtaactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcatggtggtgcacacctgtactcccagctactcgggtggtttacacaggaggatggctttgggcctagtagttcgagtccagcctgggcagcatagtgtgagaccctgtctcttaaaaaaaaaaaaaaaaactcga

SEQ ID NO: 4370 - DNA, 2271 bp, Homo sapiens
  misc_feature (553)..(553): n equals a,t,g, or c
  misc_feature (2267)..(2267): n equals a,t,g, or c
  misc_feature (2269)..(2269): n equals a,t,g, or c
  misc_feature (2271)..(2271): n equals a,t,g, or c
ctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatngacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctaaaaaaaaaaaaaaaaaaaaaaaaaaaaaaaaaaaaaaaaaaaaaaaaaaaaaaaaaaaaaaaaananan

SEQ ID NO: 4371 - DNA, 1474 bp, Homo sapiens
  misc_feature (12)..(12): n equals a,t,g, or c
  misc_feature (1471)..(1471): n equals a,t,g, or c
ctacattgagtnctttctctggctccttgcaaagaaagatacttttgtaatggtccaggaaaggaacattgctttctttttgtctttcagcacatttgtattatgctcaccttgtctctgtctcactgtgacccctttacacttgagttcagagttcaagcattccaaatataaattggaatgttggcagcccagtggcttgaaggccaatgatgagcagtccaagaccccacagcgagatgagcaactcttaggaattcccacatcctagagtgaatgcaccaactaacagtatagaatgctgtccttttcaaagcgtcctaacagcaggattacctggtcaagtatggactttctttgaatctttcttttcacaaattggactgcctgtaataccaataacattgttgtatctaactaaataaatgactgcatatacacacataccctcaattctcttgcttccccattttctttttcatcccctgtctcaggacttttattttcartgttgacctttggtttggccatatatcactgttataggaaatctcatgagaggaatggctagtgacccaactctccaaatgtctaagttagtagttacagctgattttttatgatgcataattggaatgtggagcctctgaggttgtgatagcttgtacatgaatttcaaatgtcattctaaagaatgaggggtgggagggatttatagttagaaacgacagtgcaggaaggggtattttcttgttgtcagggctggaatgaatcactgctgctcaagtcaaaggttcttgaatatccttagtttttgcatttcccctccttttcctttgacctttatttatttaattatgtatttatttatttatttatatacttttgctccattcagcacaaacacaaagcaaagcaaaaaaaaaawatatatatatatatctgtatatgtgttgtaggcaaaacactgtgaatttcacaacaaccaccaccaagcaactattttgccatcttaacatacatctcaggagacgaaatgagaaaagatggggatgtcattttttagtctatgcgtttgaggccaggtccatgtttatttatttctttagtctatgcattaatgaaaatgatcctgagtggaggttagctgaacgttcaatgtactggagcaagcatcataaaagctgctagtagccatgtgtttgaacaggaaaaatattacagaaaatgaaatgtaaaggcctatatcttgcagcttgtatatcttactattgcttaaaaaatgtataaagcagctggaaatgttttaaatacaaggtctttgaattaaatgtggattttaaatatgtaatcccttgacaaatgamcaaattatggtgaactattgctccctgcgttctttgatcattacctatgacttacaaatctgcctggagatgtggacattctgcatttgcttcygtatctgganaaa

SEQ ID NO: 4372 - DNA, 501 bp, Homo sapiens
  misc_feature (3)..(3): n equals a,t,g, or c
  misc_feature (29)..(29): n equals a,t,g, or c
ttnccgggcccccccttgagttttttttntttttttttttttttttttttttttttttttttttttttttttaaacactgtattcaggtgtcactttgaaatcagccaagatgcagtgggtcttagtaaagcaatggacctcaaaacagattgcaaaacaagaactggtaagtattagcacagagacatcacattaaaaggaagataagccaaatgaaaaggagagttccaaataccaggtcacgattgaaggggaaatatatctgtagagagatatggaaatgtgtgtgtatacggcctgggatatatacaaacatctctccagatacagaaggcaaatgcaggaatgtccacatctccggggcagatttgttaagtcatagggtaatgattcmaaggaacgcgggggaggcattagtttcaccatattttgggtccttttgtycagggggtttacattttttaaattccccctttttatttcaagggccttgttttttt

SEQ ID NO: 4373 - DNA, 750 bp, Homo sapiens
  misc_feature (728)..(728): n equals a,t,g, or c
gattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtatgtatttagacatttggcactttttgtttttgcatttggtgagtacatgctaatttccacttctccatatattgcagtggggccggggtagattcgartgtaaagcaaaagtctgtcgacagctttagataaattgttgccttaatttctttaagtattgattaaaatttgaggtcaaggctaggcacggtggctcacacctgtaatcccagcactttgggaggccgaggagggcggatcatgaggtcaggagatccagaccaagcctggccaacatagtgaaaccccgctctactaaaaatccaaaattagccagcatgggtggcacacgcctgtaagtccagggacttgggaaggcttgagccaaganaaatgcttgacctgggaaggcg

SEQ ID NO: 4374 - DNA, 463 bp, Homo sapiens
gcagaaatcctgcttttattatgttatatttatttgttcagtaagctttagtgtttagaattgtgttgcacagttcaaagttttatctctatattaactccaagaactacgggattgtgtaaaaagactgaaatgatgactgactatggggactttttcgttgatgctgttgttgctgccttctgttgtttgtwtttcttttaaagtcaggcccctcttctgtagggctgctgtggtttgctcggggtccacttcagaccctattcacttgggcccctcccatacctggaggtgtcatcagtggaggctgcagaacagcaaagatggctgcctgctccttcctccgggatctccgtcgcagagggaaaccgacctgatgctagcaggaatgctcctgtaaaaggtatctggtgacccctgttggagagkctyacccagtcaggaggcataagatgcaggacct

SEQ ID NO: 4375 - DNA, 1881 bp, Homo sapiens
  misc_feature (40)..(40): n equals a,t,g, or c
  misc_feature (42)..(42): n equals a,t,g, or c
  misc_feature (58)..(58): n equals a,t,g, or c
  misc_feature (111)..(111): n equals a,t,g, or c
  misc_feature (182)..(183): n equals a,t,g, or c
  misc_feature (1854)..(1854): n equals a,t,g, or c
  misc_feature (1862)..(1862): n equals a,t,g, or c
  misc_feature (1880)..(1881): n equals a,t,g, or c
tagggggtttccggggcacattttccccgaaaaagtgccncntgacggggccctgtancggcgcattaagccggccggggtgtggtggttacgcgcagcgtgcccgctacnccttgccagcgccctagcggcccgctcctttcgctttcttcccttcctttctcgccacgttcgcggctttnnccgtcaagctctaaatcggggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgagtttttttttttttttttttaaatctctggcaagttttggtatcacagtgatgctggcctcataaaatgagttagggtgaagtccctccttttcaattgtttggaatagtttcagaagaaatgctatcagctcctctttgtacctctggtagaattcagctataaatccgtctggccctggggtttttttccttgagaggctatttatgactgcctcaatttcagaacttgttattggtctgttcaagaattcaacttcttcctggttcagtcttgcgagggggtatgtgtccaggaatttatccatttcttctagattttctagtttatttgcatagaggtgtttatagtattctctgatggttgtttgtatttctgtggggtcagtgacagtatcttttttatcatttttcttgtgtctatttgattcttctcttttctttattatttcagcaggtggtctacatttttaaataaataataataaatcctggatttatttttgaagtgtttttcatgtctctccctccagttcctctctgatcttggttatttcttgktttatgtwagctttggggtttgtttgctcttagttttctatttctcttagttgtgatgttaggatgtcaatttgacatctttctagctttttgatgtgggcctttagtgctataaatttccctcttgacactgcttcagctatgtcccagagaatctggtatgttttctctttgttctcattagttttaaagaacttcttgatttctgccttgatttcatgatttatccaaaagtcattcaggagcaggttgttcaatttccatttagttgtatggttttgagtgaatttcttaatcttgagtttgaatatgagttcactgttgtatgagatattgtttgttatgatttcagctattctgcatttgctaaagagtgtgttmcttctaattatgtgatgaattttaatgtaagtgccatgctctgctaagaatgtatatcctgttatttgtgggtggagagttctattgatatctatcaggtccacttgatctgtggcagatccwgtctagactgcctctttaggctggaccctgactgatccttcctcactggrtgggggctccctaaagcaaaatcgngactgtcnctttaccatccccccgtnn

SEQ ID NO: 4376 - DNA, 665 bp, Homo sapiens
  misc_feature (612)..(612): n equals a,t,g, or c
  misc_feature (642)..(643): n equals a,t,g, or c
  misc_feature (652)..(652): n equals a,t,g, or c
  misc_feature (661)..(661): n equals a,t,g, or c
gatgacatcttccatgtgttatggtaatttattgctgaaagaattaagcacatcctgggtgactccatggggagaagactcttagaaatttgtttggtttcctccaaactttrmccatgcgcaactttcagctttgcttattttgctttgtgttttttcgctgcaataaattttagttatgaagcagactgcatgctgagtcccatgagtcctcctagcaaatcactgaacctaggggtggtcttgggggacactracacagggagttgattgtttggcaacacaagttgtttcagagcaaatgaattctttttccacaagctagcatattagtaaactatcagggagcataaaatcagttgactgagttctgtcgggaaacaaagggaaaatttttcttcaaaaagacatgatatcctccctgttaagcaaagcagtactttccctatggataagtgtattcagttggaatgtgcttggctgcaagaaactgaaaactattatattacaatgctttaaagaggctagtgacttggttctgagggaaagatatctaggagtggtacaggcactcagtgatgatttttctttttgcttcaccatccttagtgnataggttttggcttcatgggcacaaggcanntgttccagngccatggantggt

SEQ ID NO: 4377 - DNA, 1335 bp, Homo sapiens
  misc_feature (1)..(1): n equals a,t,g, or c
ntttgtcttcatggtcacaaggcagctgctacagtgccatgtattgcttgatgtccaagctgatcaggaataggagaaygtgaagggcaaaacccaactctgccctctctagggacttcaatttctatataattgactagcactgtcccacaggagctgaaaattcaactacttcacttttcaatactggaaatgagtggtaagaaacttggactagatgatcgatggtccacataaattatctgtcacaattcttctgacactaatagaacagcaatacaagattgtcgttgattccctatgtgaagatcctgtatgtggataccttgattgtaaggctgagagattaaagaccatagtaacttttgttaagtggtctccttgtcactcacatacctttgctcctgagttcttccataggtgccactgaacagcttccttgaggtaaactcttctgaacttgtaacctacattaactgggatattaataatctcttttaatcttaatgctcttatgaaatgacataaaaagaagaaatgcattgcactgttgtatgagcagataagacaaaatactaattctctccttttccccccatcctatcttgttttctttctcagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaaraaaaaaaaaaaaaaaaaaaaaaa

SEQ ID NO: 4378 - DNA, 1921 bp, Homo sapiens
  misc_feature (1911)..(1911): n equals a,t,g, or c
  misc_feature (1917)..(1917): n equals a,t,g, or c
ccccgtggaaggggcccctctttcagggcaggacatgaccctaaaaaaacacgtgttctttatgaattcctgcaacctggaagtcaaaggtacgcagctcaaccgcatgggcctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccattgtgaaagggtcatttttaatctctgtggtgrggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgcyttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctcaaaaaaaaaaaaaaaaaaactcgagggggggcccgtacccaatcgcctnacatgnatcg

SEQ ID NO: 4379 - DNA, 1420 bp, Homo sapiens
  misc_feature (1355)..(1355): n equals a,t,g, or c
  misc_feature (1375)..(1375): n equals a,t,g, or c
  misc_feature (1388)..(1388): n equals a,t,g, or c
  misc_feature (1408)..(1408): n equals a,t,g, or c
  misc_feature (1419)..(1419): n equals a,t,g, or c
ccttggttggtccctttgataggtttccagcgctctctgctgggtggctttccatctgtgtctcacagacaaaggagagtctgatgtatccacccatctagtgtaagacagagatagcaaaggcggaacaaatggagtccatgccccgaggctgtgccctcaagctggcctagggtcagagaagggaggagatggtagcagcagaaccacagcacaccactgagcactggaaagagcaagagctgaaatcttaggttattggatatgcctagagtcagaaaagccttgggaaatttttggtgatcgatttttcctgtgaagggggaagctgctgatggagacttgtatctgcagtacttcaggttcccagctggctccccatccccaccctataacatgaccggcgtacagaaattaattggccgactgttaccaccactagtctgtccctggctagactagacagatgggtgtgcccctgggctcagtggtagcctacccggggtgatggtggggttgccagctgtartccarctgttctggggcctgtgtttgtgcacctgtggtctgtatcctgccccacaragctggctgtccagtggaraatacaaagtgacatctggtgctccctcagaaagaatgtggccccagaggcatgccagtggctttagactctctgggaggacatgtttgagagcaacagccccttccccatcttttcctttcttctcagcagttataaatctctctgcctgcagtaartagagtgagtggctggtgasgargtttgttgatgacactgacaatatctggtgactccctccagatgtgcactcagcagtgagctgggcagaggcgtgggaaggacgttggctgggagcagacggcctctgcaaatgaatctctagtttcctgcaacctgggagtgtccccatgagttttactttcctactttatgaagtgaacctgctttctttgggatttcatgtactcctaatgctttttctctccaggtatttctttcctgctacatattaggactcccaaggcaagagtgcacctttatttagacctgggagtaaagggaaagagttgcctgtctttcgtgtgttttcagctttggctctgtgggatcagttatgcctcattcctgaaaagggcctttttatccccccagaatgcttttgctttgccaataccaccttcctcagcctgccttttggaaaggttgagaagctaaaaagtcaggtaagagaaggcagagatggacttcagaacctgatttttaaattttaaggcaaggctggctgccactggtgagagtgatgcagcagcctagcgtgtttcccagcagnagggtttagtcttttgcccnaagaagttcaccncgtttattgagggttgctantcacagtggcnt

SEQ ID NO: 4380 - DNA, 1045 bp, Homo sapiens
  misc_feature (106)..(106): n equals a,t,g, or c
ggcacgagctgaacagcttcctagagggaaagtacctcttttaaactaagttattatagacagtgaatgaatcctacccttaaaagagatgacggcagggtaagtncaaagtaaaacctccttgctctagtctcttgggagagtattgtaatgaaagcagcgtttacttcgttgttgttgcattkgggtgaaaaatctgagatgctggaatgatggcaatgtttgccttctctccttcccttcctgacagccagtgtgggccaggctccactctccatcttcacaccctgcccttgctccagtatttccattctgtttttctcctctgtctctttctgtctttctctcaaactccatcctgcttccacccctgcccgcttttcttctcctttcctggaagtaatcattaaacaaaagaaaaagttgaatgttctttggtgagtttccttcttctctgccttttccttctttagccagttcccctcaacccctgtgcactccataggaaggacaaacttacctgtctgctttcttcccatgtgcttctccccaaattttcatatagatatatacgtacactccttttggaataaacgaagaggtacattatattkgacacaaacttgggagtgttaagaggtcataagtgtttacctatcagataaccatctgtggctctgtgttggattttttttataccattaggaaaatgggaatttttttataggcctgccatacttctactttgccaaatagcactttattatcaagatacacccatggctcatttcagactcactgaactttttttatatgaatgcacagtcgtcatattttgggcagtctgtgagttcttggtaactcatccccttactacaaaagcactaagtgaacaatacaaaagtataaaagcacaaatttgaacttacatagtttagtttaagtatgtttcactagaaaatcaaatatttagatttctcacattgaaaatgcttaggattgaggtttagctgcttcctttaaaaaaaaaaaaaaaaaaaaactc

SEQ ID NO: 4381 - DNA, 3398 bp, Homo sapiens
gcggcacgagcacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcgrtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaaaaaaaaaaaaaaaaaaaaaaaaaaaaaaaagtcgagc

SEQ ID NO: 4382 - DNA, 1013 bp, Homo sapiens
  misc_feature (317)..(317): n equals a,t,g, or c
  misc_feature (728)..(728): n equals a,t,g, or c
  misc_feature (749)..(749): n equals a,t,g, or c
  misc_feature (1013)..(1013): n equals a,t,g, or c
aatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagragggtaaggatggacactaaaatgaaacaaataccaaggtattccttctgctgcagcctggagaccaccgagagtcgagctggggcacacacacacctggccgggacccgcagggacaaggcgggccgtggcntcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggyrgctgatgaggttacatggttacatgktctacatcatgcakagtagcttgaaatctnagtctggagaaaactggatcnaagattctagcccactggagttgcaaggaatgagaggcaaaaattctaaagatttgggttatattttcaacttgggggacagagagaaatggagagcaggaattacagttccaacaaacatcatgatagkctggkagtcaagacagagattaagtaaaacaggttttactgkttagctgagttcaggtaatacmaaatgwcataaaacgktagtcctttgagactgacatgattaatgatcartgtggtgggaaatgattgggn

SEQ ID NO: 4383 - DNA, 701 bp, Homo sapiens
gaattcccttgcgaccgagtaatttttttttttttttttttttcttttcattttgaaaatgctttaataagtgttgacaacactgttttgcaaaatgtaaagrtactatacaaattcttaatacaaaaagaataaattaaaagcagatttctttttttaattctgcaactttgtctacaacgtacatctttttcattgattacagttgaacagaatccagtaaaatcattttacatgctctacagtcagtttcaggagcaacctaatcttttttcccccattattaaactagagtccattttacacaacttgtaataaactattgacattaatgtatatgtaaaactttacacctagttaactaagcagtaactggtcatctgatagcacctggatggggtttgctatatttagaactaaactaatactgaatgaaaacaaattggaattttaacagtttcaacactcacctgcatataataaaataaaaaatcaacctggctcacaacatagtctgatgtatgtgttttcaccagtcttctggctgaaacaggcaatttcttttacgcatccgaagaatccartaggggctttatatcagaccaaggattcgtatttcaccttattttgttttaaagaaatagggataaagagtttgcaagtgcttgtgtacctcggccgcgaccacgctaagccgaatt

SEQ ID NO: 4384 - DNA, 814 bp, Homo sapiens
  misc_feature (1)..(1): n equals a,t,g, or c
  misc_feature (3)..(3): n equals a,t,g, or c
  misc_feature (10)..(10): n equals a,t,g, or c
  misc_feature (556)..(556): n equals a,t,g, or c
  misc_feature (813)..(813): n equals a,t,g, or c
nanaacttcntgtttctytggrtwccctgsccgatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggcagctgatgaggttacatggttacatgttctacatcatgcagagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgnacacaagcacttgcaaactctttatccctatttctttaaaacaaaataaggtgaaatacgaagtccttggtctgatataaagcccctattggattcttcggatgcgtaaaagaaattgcctgkttcagccagaagactggtgaaaacacatacmtyagactatgttgtgagccaggttgatttttwattttattatatgccaggtgagtggttgaaactggtaaaaattcccatttggtttcattcagtattaggtnc

SEQ ID NO: 4385 - DNA, 2027 bp, Homo sapiens
  misc_feature (39)..(40): n equals a,t,g, or c
  misc_feature (45)..(46): n equals a,t,g, or c
  misc_feature (1949)..(1949): n equals a,t,g, or c
  misc_feature (1959)..(1959): n equals a,t,g, or c
  misc_feature (1964)..(1964): n equals a,t,g, or c
  misc_feature (2008)..(2008): n equals a,t,g, or c
ccgcggtggcggccgctctagaactagtggatcccccgnnctgtnngaattcggcacgagaaaccccctgtatgtgaaccttagattgtaaggcaagccagtgcactgtgtaatatgcaaagggagtggtgcaaaagagaaggcacccgtcccagctctccatgccctttccctggcaggcgctgactgagatggcgctgagtgaatgtggaaggtgctaagacccagtctcttcactgcagggctgtttacagccagtttcttttactctgaccttaaggtttccactgagctcatgaaacttcaacatatggtgtttaaaagtttcccactcaaatgcacacttgaaaattgggtccctcagcctcattactgaactaaataagtgaagaagttgtatctttggggtaaaactttccagggccacttaattttttaaccagttaagtacgcatcttcctggtggttcagactttttaagtcagtgctaaagctgaaaagcgccttctaaatatgactgtgagtttagtttgtatcttacatttagtaactgttctgttgggccaggactatgactttaattactatgtacttattcatcccacactctgcactaaatacaccatagctactatagcattgtggcaggcactcatttttgtggactcattccatacttctgctggcatatttcgtttaaaatctagctaaagattttcatagtactgtgttaactagccagggctgaaaagtgtgacaggatatcaaattgactttccttggggaaaatgttgctttggcaatagtgaagtccaactccttcatttacagaattagtgattactcatcaatttttgaaagttgtagattaagtagttttatttactaaattcttaaccactttgaagatttaagccagttgaaatgaaacattggctggatgcagttggctagcacctgtaatcccaacactttgggaggccaaggtgggaggattgcttgaggccaggagctcaagaccagcctgggaaacatagatttgaaatcttttcaaaaatgtataaaaatttaataaataaataaatgaatccttactcaaccataattatggctttaaaacccaaccaacagtaaacacttacttgaagccaaaacagtaaattttgaatgaaatttgaattatgcttttggaagctgccatgtcttaattcttgctggattttgattttcaattttggaagtttttatcaaaactgtccagtcatgagtatatcaggtagcagcctttaaggatctaagtttcattcctataaagaacaggaggtgctggtatttcttgtcttagcaagtgatctgatgcaggtctaaatgggggttagcatctatactatggcttaaaagtttcctccttggtcaccatttgggaggtgatggcttcaaagctaagctttgctctcatgtgacccttctttatcttaatacccaataagatataaacctctcagagtcaacccagtgtagactcaaagggtcttagcttcatctatcagataagatctatctgatttatacaaagaatggtgctgtttttatatacatactaaaaaaatctaattctcaaacaattttcttaatatttatgccagcaaggtcaggaaagactattttgtcctgtttaactttagtagtgaacaaactgctagagacatctgtcatccttaacaggccactgtggtccttatatactgaccctcctttccaattaacgtcctttaatcccatactagttccataagagacttgggcacataaaagcagtattttttttaatgcctagtaaactggccagaaaaaaattattggccatggtggacctgtttctattccacctcttttctatgggctatattagtctatacatggccagtttccgttacatactccatttnccaaaggagnccccnaaaccctgggattaggtaggcactaaccagggatttttaggggntcacaaaacattttccttc

SEQ ID NO: 4386 - DNA, 687 bp, Homo sapiens
  misc_feature (14)..(14): n equals a,t,g, or c
  misc_feature (21)..(21): n equals a,t,g, or c
tggccaccataaanccagtantttttttaaatgccctagttaaactggcccagaaaaaaatattgcccatggtggacctgtttcctatcccacctctttctatggcctatataaktctatacatgcccakttccgtacatactccatttccmaagagcccccaaacccctggayagtagcactacctgaattttaggktcacaaaacatttccttctgaaggaagcagctgcctcagcagtgtcactttaktgaccactgcccaggcttacttcactttgcctccccctacacatcactgccctctttctgccaccaaacctcactattccagcaatgatgcctccctggtgtctggaaaacccatctggtgcactaaaatgctatgcaacaccaaatggcttcttcccctaatattgctcaacaatgtaaattcywcaagaataaacttcatgctatgttaacatcaatgtatggttacagcttccttttttttttttttcccttttaaaatgaagcaaaccacctccattaaaatccatgttttggggcttgtttttgtctctcaagtgtgaaatataaatcatgtttttatgatttttgtaaatctttttacaccttgtttttgtaagcaaaagtttcttattaaaagaataaaatgacaaaaaaaaaaaaaaaaaactgcgta

SEQ ID NO: 4387 - DNA, 3798 bp, Homo sapiens
ggcacgagtgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggctgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgctcttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaaaaaaaaaaaaaaaaa

SEQ ID NO: 4388 - DNA, 4001 bp, Homo sapiens
ggcggccggggctggagaacgctgctgctccgctcgcctgccccgctagattcggcgctgcccgccccctgcagcctgtgctgcagctgccggccaccggagggggcgaacaaacaaacgtcaacctgttgtttgtcccgtcaccatttatcagctcagcaccacaaggaagtgcggcacccacacgcgctcggaaagttcagcatgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcakaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacraaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactrtaataacctgtctccaaaaccatgccataataatataagtgctttagaaattaaatcattgtgttttttatgcattttgctgaggcatscttattcatttaacacctatctcaaaaacttacttagaaggktttttattatagtcctacmaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgamcattgaaacatcgacgtaactggaaattaggtgggatatttgataggatccatatctaataatggattcgaactctccaaactacaccaattaatttaatgtatcttgctyttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaaaaaaaaaaaaaaggcggccgc

SEQ ID NO: 4389 - DNA, 923 bp, Homo sapiens
  misc_feature (819)..(819): n equals a,t,g, or c
  misc_feature (835)..(835): n equals a,t,g, or c
  misc_feature (849)..(849): n equals a,t,g, or c
  misc_feature (856)..(856): n equals a,t,g, or c
  misc_feature (911)..(911): n equals a,t,g, or c
ggcggccggggctggagaacgctgctgctccgctcgcctgccccgctagattcggcgctgcccgccccctgcagcctgtgctgcagctgccggccaccggagggggcgaacaaacaaacgtcaacctgttgtttgtcccgtcaccatttatcagctcagcaccacaaggaagtgcggcacccacacgcgctcggaaagttcagcatgcaggaagtttggggagagctcggcgattagcacagcgacccgggccagcgcagggcgagcgcaggcggcgagagcgcagggcggygcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtggttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccatattaaaatcacattcaagnccgatgactactttgnggcttaacctggantcaagantaattaatctttgctggaagattccaacccggagcaacttcagaaaccaactggnaatctgtcacaa

SEQ ID NO: 4390 - DNA, 2726 bp, Homo sapiens
aattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaaccattagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagsttacatatgtttgagttagactcttaaaatcctttgccaaaataagggatggtcaaatatatgaaacatgtctttagaaaatttaggagataaatttatttttaaattttgaaacacraaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactrtaataacctgtctccaaaaccatgccataataatataagtgctttagaaattaaatcattgtgttttttatgcattttgctgaggcatscttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgcttttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatstatggagcttgctttaagaagccagttgtcaattgtggtaacacaagtttggccctgctgtcctactgtttaatagaaaactgttttacattggttaatggtatttagagtaatttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaaaaaaaaaaaaaaggcggccgc

SEQ ID NO: 4391 - DNA, 522 bp, Homo sapiens
  misc_feature (31)..(31): n equals a,t,g, or c
  misc_feature (437)..(437): n equals a,t,g, or c
  misc_feature (475)..(475): n equals a,t,g, or c
  misc_feature (501)..(501): n equals a,t,g, or c
gctctgtggtgcctaccctacgcctctccgncgtcctcccccgaactggtggttacgcgggccgcgagttaccgtcccagcaggcagctgattgtttagatggagagaccacaggggagagttacctgttgctgtgggagcaatgaggagttatggaggaaaggagaggtaccaagaccagatgaggactgaacattagacttcccatgattgcagaactgtccttcgctgcagctgtaaaatcgcggcaaggcaggattcatcctggtggtgggtgcaggccctgattcccgtcactgagcagggatacagcaggaagctccacctctgagcacagcaaggggattgttctgattctgagtgtgtctgtttgctagagcggtggccacacttccccggttctgcaattgtggataatttagcatgacttgttgggnattgcaaatatcatgtcgtggagagtctgggctctgtnattttttccagctgtgtgtgtgtgtntgtgtgtgtgtgtgtatacat

SEQ ID NO: 4392 - DNA, 608 bp, Homo sapiens
  misc_feature (8)..(8): n equals a,t,g, or c
  misc_feature (11)..(11): n equals a,t,g, or c
  misc_feature (37)..(37): n equals a,t,g, or c
  misc_feature (68)..(69): n equals a,t,g, or c
caaagctnggngatttgcaccagcatcagagcatctncctctcctcctacccaagaaaaatgctaccnncccttttcctctaattagaaaattctttggtatagtaggagattattaggaaataatcatttctctccaaaagtaacacactgaggaggcagtatctgagggttttgcccaaatatggcctttcaacctctgaattcatgcctacagaaattccaagatgtttgtcatagcatttttattctaaccctccttaatgagtgatacagtttgcctgtgtccccacccaaatctcatcttgaattgtagctcccataatccccatgtgtcatgggagggaccccatgggtggtagtttattcatgggggcagttaccctcatgctgttttgctaatagtgagtgagttctcatgagatctgatggttttataaggggcttttcccccttttgctgggcacttctccttctgccgccacgtgaagaaggatgtgtttgcttccccttctgccatgattgtaagtttcctgtggcctccccatccctgaggaactgtgagtcaattaaagctcttttctttataaaaaaaaaaaaaaaaaactc

SEQ ID NO: 4393 - DNA, 2393 bp, Homo sapiens
  misc_feature (1324)..(1324): n equals a,t,g, or c
  misc_feature (2336)..(2336): n equals a,t,g, or c
ggaaaatcccccttcatcccccaggactgtcctttactctttgatagtatccctctattttcttcccaattctctaaatgctttatcattttttcctgagatgcttctgagggatgctgacctcccactatggggaaaagggttgcttggaggacctggggtggcagccccccgaccagaagcaccctattttatagatagcagtctgaatggtagagagtcctgtgtgtgggttgttagaaggttggttcttcctgttattctctctggctttcctttcaacccacttattttcagaggcctctccccttagcatcctttaaaaggttttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccatttttttttttttaacaccaagatcctaagtaattccaaatgccttagatatcaatgaaagctacacaccattgagatgggcaaaattctttctctacaaagggagtaatcaagtaaatacctgttctctttcaatggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatayataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaatgctaagaacagaatacagacataaataagtcacggcccatgaccttgaagagcttacggccttataaagaggttcactgtaattgtcttcaccagggcgtccttctcaaagatgcccacttttgtctggcacattggggctcggtggtctggtggtcccttcggtcttggccctatctgtcctttgnttttgtgatttactaacaatcatcacgaaccagttttgtttttcttttaaatttgaacatcacatcttgtgttttagttttttgctctatgatttttttctcactgcttttcagtcttctctgtacttcatttttgtgaaaaagtgaaaatcacatataatctttatttaaaaatgctcaccaagcactgcagactttggagttagggattcagcagcttgttccagtgaaaaggaggagtgaagctggggaagttagtatctaagaggggcaagctgattgcatgtgcatttatacctatgcctttaaaacattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcacaccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtstagcttaaaagtgtaaacattatgtgattcatttgaatacaagaatgcctatgaaatacccactataacagcattccttttgtgtttagaactatagaagaaaatgtcttcaaataaagtagttttcagtcaaaaaaaaaaaaaaaaaaaactcnagggggggcccggtacccaattcgcctatagtgagtcgtattacaattcactggccg

SEQ ID NO: 4394 - DNA, 2500 bp, Homo sapiens
  misc_feature (2459)..(2459): n equals a,t,g, or c
  misc_feature (2473)..(2473): n equals a,t,g, or c
  misc_feature (2475)..(2475): n equals a,t,g, or c
  misc_feature (2478)..(2478): n equals a,t,g, or c
tccaagctacgccactcgggctggggcgttgggagcgggagtgcagagcgtggtcgtggcggcggcggtgagaagagcgaggcgkaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtacgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgsacaacacagatttatacatactttgtttataaaacccgaaatatggatatgaaacgtcttatcatggttttggstggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattggaagttkggaagttcatgaggctgaagcctgtgccagaaaatcacccacagtgggatacagcaatagagggggatgaagaccaggaggacagtgagggctttgaagatagctttgagggaggaagagggagggaggaaggaaggtggtggacttaaggcagttactctggaatgggacccacagtgttttgcaccatattttggcaattttttttgcccgtttttnggaagtgttttccntnaancccaggaaccattacagaaccg

SEQ ID NO: 4395 - DNA, 2506 bp, Homo sapiens; identical to SEQ ID NO: 1506

SEQ ID NO: 4396 - DNA, 774 bp, Homo sapiens
  misc_feature (714)..(714): n equals a,t,g, or c
  misc_feature (734)..(734): n equals a,t,g, or c
  misc_feature (758)..(758): n equals a,t,g, or c
  misc_feature (767)..(767): n equals a,t,g, or c
gcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgrttgtagcaggagctgccacatggtccatcaagattcacaatggtagcagtgaagcgctttctcaatataaaatgaacatcaccttcatagcaccacttttagaaaaattggcaaagactagtgatgnttaatggggtcttacaagancctggttatgaagatctattaagnggaaaattnggaagat

SEQ ID NO: 4397 - DNA, 855 bp, Homo sapiens
  misc_feature (183)..(183): n equals a,t,g, or c
agccaagttgacctatggaaagggatttaggttaagtatgaaggagaactatgtaactacaaatttycmcaaacagtggaacaaattattttaagttttttccycttattaagcagtggttcttaacctttgtgagagttgcataagccctttgagtatctgatacaagacaatggtttkgtncttctcctgcagaataatgtgtatgtttgcatgtacatatggttctccatatacataaaagggcttgatgaaccccctaaaaactggttaagaaccttgcagtggaatttgcaggctagtatctgcaagagtgccaggcataaaaccacctgcagtctcagggctaaaaggatgagattttctcaaatcttgattattttgaatgtttaggcttaaataactaatcatctagagttccacagatgcctaaactatgaagtttttataaaactagagtttgactgaatcttcaactagacagactcaactttcccagaataattttattataatcaaaccatgttgaargttctaaattttatttaacattagatatcttaaaacttgtagaatcctaaatggcctataaactrtaatccaaatgaaaggcatattacaaatattgctagctaaaaattaataattttttagtggcagttattttgtgctttttttcccccacatttaaacagtagactttatcttaagtggcctggtatcttctgttttgaaagtcttctaattaaaattctttggtccttgatgtctgtcagcattttttaactaaaggtcacaacccattaacaaccatgaaattggtgttgggaagaaaaaaaaaaaaaaaaaactcga

SEQ ID NO: 4398 - DNA, 2575 bp, Homo sapiens
  misc_feature (1)..(1): n equals a,t,g, or c
  misc_feature (66)..(66): n equals a,t,g, or c
natagcatacgccagctcgaaattaaccctcactaaagggaacaaaagctggagctccaccgcggnggcggccgctctagaactagtggatcccccgggctgcaggaattcggcacgagctgccgtggtaccagcctccagcctgcccccaggactgcccctgacccaggcgcgcccgctgctcggtggcaggagggccggcggagcgccatggcctgcatcctgaagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagagtccagtctggctcatatctcagcacagggtggtttaccttcattctggccatggacgcctgttatggcattcacgtctacgggatgataaatgacacctactgcaagacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttgataatggttttcctgatcttgccgcatcacttaatgtgatccccatactgcaactgtgatgctgatgatgctaatggagatgatggtaatgataaagacaacaacaatgattatcaagttcctgtacactctcagatgtggatggtgactctgctagtaatttaaacttggcatttcatggaggatggttgtgctcatgatgttctttctggaggttcaacactacgtaccgcactttataatttaactggaattgagatgaaggccagtgacatgacaactgtgacctaagaaatgggaagattatctttcaagatagctgcctagaattgttcgacagtgagtaacttccagaagccaaaagagtttggcttcatgaggcaaggtgattgactcaatggcttgttgaatctcagcagttccgccatcttgaagaatgattgattgtcaaacactgacccaagaactgctatcagggtgcaagtatcttactagttagcctaaggatgggaaaatatctcttcctaatataccatctttctacagtatttcctacagctaaagcctcaggccattgcctaattaacaatgaagatttcatggacatcctacacttcaggattacttgactatctcaaacacataaatcaaaatgggccaagtagcaaatcttgatgaatttccactcttaccatccattcttactaccaacagtataactgaacatgtgattagaatgatctatattaatgtttagttatttttggttgagtgctaaatatttcagaaggctacttaacatgtaagataccaacttcaacactgtaataacatatactgtgaaaacattcctaaaaagtaaccaaagggtttgctaactctgcttcaacatccaacaacacaaaactatatgatttttaaaatcatgaaatagagacagcaaagcatatttttacatcaatttgtatcctatcatacttcataatatatatttgtatattcaaatttctattttataggcccaaggtgtgtttctccaaacattacattctcattgccaagtgccagctgttacacatggagaggaaatgattccttatattaaacctgaccagagctttttgccttctagggatttatttttcccatagtgtatcagttgttatgccacaataacaacaataataatgttcttaatgtccaaagtgctttgtcatttagagtcctttaacatctgttataccatgtgatgcccttgaacaccccattgggctattgtctstgtattctgctctctttagcagatgatctgtaatttggtcattgttctgttatattccagattgctctacttgctaatatttgtatagaatagaatttatgtaaactagtaaccagttgatctctgtgccaaatacctgtctcttatcactctcaaccatcatcga

SEQ ID NO: 4399 - DNA, 725 bp, Homo sapiens
  misc_feature (655)..(655): n equals a,t,g, or c
  misc_feature (682)..(682): n equals a,t,g, or c
  misc_feature (711)..(711): n equals a,t,g, or c
  misc_feature (721)..(721): n equals a,t,g, or c
gctgccgtggtaccagcctccagcctgcccccaggactgcccctgacccaggcgcgcccgctgctcggtggcaggagggccggcggagcgccatggcctgcatcctgaagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgcccataccagcgktcctcttttgctaaaaaaccctgawtattttttcaaggaagcgaatactactawttatggtawttggggacctttccgcaatatgaggaaaagawggcaatggcatcgttacmacatgktgaaaaaracagttggaatctatccaatgcccaaawatcgtgacccngagaasccatgasttatggtgatggantttttaagaaaggaaactggcaagggacnagaagtcccnagtc

SEQ ID NO: 4400 - DNA, 617 bp, Homo sapiens
aattcggcacgagggaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatcaraaaaaaaaaaaaaaaaac

SEQ ID NO: 4401 - DNA, 4303 bp, Homo sapiens
  misc_feature (20)..(20): n equals a,t,g, or c
  misc_feature (24)..(24): n equals a,t,g, or c
ggcacgagcagcagcggcanggcnggcgcggagtcccctgcgcccagcggcccggccgggctgcggcagaggcggcggcggcgccccgctccgggtgaggttgccggggccgtgcgcgctgatctgcgagtgaagagggacragggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcaccggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcartcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggatttaaaaaaaaaaaaaaaaaaa

SEQ ID NO: 4402 - DNA, 1140 bp, Homo sapiens
  misc_feature (11)..(11): n equals a,t,g, or c
  misc_feature (14)..(14): n equals a,t,g, or c
  misc_feature (29)..(29): n equals a,t,g, or c
  misc_feature (37)..(37): n equals a,t,g, or c
accctgcaganctntatatagcttcatcntggaattncccttgcccatcattcgggccgttcggcaaatcatgatcgactcagtaatagcgtgccagtggtcaaggggttggttcttgtgggtgcaaaggaatgtatcctccttgcccacttcaaagtttgtcgtgagaagctgttttgtttgagacaggccttcgatttgctgattctggactgtcagaaattttaggttgcctcccacccaacatggttttctccctttgtttatggagctatatatctttatttctctctcttccccctaccttggcattttaaattttgaacgcataaattgccctcctcccttcattgctcacatacagatcccatcttgactgcaactggttgtgattttgcctgccaccaggttgtttcttttttgtctgctttcagtaaacttagaatgttagatttctgaaagccacacagtagaaatttgttggtatttgatacgtagaacagttaaagtgacttctcaacagccgatttttgtttgagtagagatttgattttttgcttgttttaagtagataattgctaatagtaatgtctcatcttgatgactgtgactaaaaatagtattatgatttttatggtaattttatcttagtcaatattgaccatttctttttgccttgtcagctgaattttttgkttaattctaaaaaataatgtgactgagttgacttttaagcaacagtaaatttattattgaagactaatgtgaacactgacattttaacatttaatagccgttttaaactgggtagttggcaaatattgttgatcgctctgctattaatatgaaaattgtatacattcagttagaacacactgaaccaactttgtgctcaaaatgatatacgtatcaatgaaatatttgcctgtgaaataagctcacttaattccattggatcgtaggctttttaggacaaaaattcagataaaaaaaacgagtaagatttctcttggctgtataattatctaacaactgcatttgttttcagaatttacaatgttgtaattgtaataaaatcaccacctatcatttatcataaatccccaaaaaagtaaaaaaaaaaaaaaaaaaaaaactcga

SEQ ID NO: 4403 - DNA, 670 bp, Homo sapiens
  misc_feature (1)..(2): n equals a,t,g, or c
  misc_feature (13)..(13): n equals a,t,g, or c
  misc_feature (21)..(21): n equals a,t,g, or c
  misc_feature (639)..(639): n equals a,t,g, or c
  misc_feature (655)..(656): n equals a,t,g, or c
  misc_feature (667)..(667): n equals a,t,g, or c
nnccccccccccngggggggnaaaaatttgatgggcaaaaagaagagtctgctggrgggggcctaggattccagaagcctggggaggcacaccctaggctcggggaaggagagaggtggagaggggctagcactcctcaccgtgattatctttctscccgatattgtgcgtgcggatgagagaggagagtctcctcacatcccccttgaagacgcactcgtgcaccgggtagtgtgcggggcaactgcctccatccgcgacgacagcaacggggttggtgccggccagaagggccggggactgggagttggcagtcacggaggaattgtgcagcggcagagccggggcgccggggggattggaggaggccggagctgccttcagctgtagccggtggtgatggttactgaagatcttatgacaagctttgccgcccttgccaatcctgcttctggtaaaggtaccgccgagggcagccgccgcttcctcatccccgggctccagcaggtccccttcttctttgctgggcttgtggtccctccgcagtgagcggatcttctccccggtcatcgccgccgccagggmaagrgggggaatcgggaggctcaccgctggcgacggagctggcgggtgcggcgncaaaggaagttgaagnncagcctttccnctc

SEQ ID NO: 4404 - DNA, 1314 bp, Homo sapiens
  misc_feature (1)..(1): n equals a,t,g, or c
  misc_feature (1032)..(1032): n equals a,t,g, or c
  misc_feature (1098)..(1098): n equals a,t,g, or c
  misc_feature (1222)..(1222): n equals a,t,g, or c
  misc_feature (1272)..(1272): n equals a,t,g, or c
  misc_feature (1307)..(1307): n equals a,t,g, or c
nggaacaaaagctggagctccaccgcggtggcggccgctctagaactagtggatcccccgggctgcaggaattcggcacgagctcgtgccgaattcggcacgagcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagaracgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgngccactgttatacaagttgactgcctttgcatacaaagattatttatcatttggatatgtatatgngggtttgagagggacggaagagatgacaaggcggtacaacatcaatatctacgcccctaccctcttggctttaaagaacatataaacaggcctgccgatggtatccaggccccgaggtatgaanaagcaaatcattgacgacttcatcacccgaaacaaatatctattggcagncaggctcaccagccagaaagttggtccatgaactntgccctg

SEQ ID NO: 4405 - DNA, 612 bp, Homo sapiens
atgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcga

SEQ ID NO: 4406 - DNA, 733 bp, Homo sapiens
  misc_feature (716)..(716): n equals a,t,g, or c
  misc_feature (720)..(720): n equals a,t,g, or c
gatccctaaacaagtctttgtgtggacatatgcttttacttctcttgagtaaatacctaggagtggaattgctgggtatttttaactttttaagaaacaagctgtttctcaaagtggttgtatcacttgaaatcctaccagcactgtatgaactccagtttcttcatatccttgccagccttgatatggtcagtctgtttaattttaggctggtggcaggtgtctagtggtaaagtagctcattgtggttttatcttctgtttccctaataactagtgatgttgagcctgttctcacgtgcttatttgccacctgtatttttatttatttatttgcttattttgagacggagtctcactctgtcgcccaggctggagtgccgtggcgcaatcttggcttactgcaacccctgccttctgggttcaagcgattctcccacctcagcctcccgagtagctgtgtctacaggcatgcgtgaccatgtctggctaatttwwgtatttwwagtagagatggggtttcgccatgttggccaggctggtctcaaactcctggcctcaagggattcgtctgccttggtctcccaaagtgctgggactgcagatatgagccactgggcctggtggcccctgtatatawwwaaatgtctcaaaatggtttacccattttcaatttggtgtttggcattactgaattgtcctttaacctagaatcangganaaaatttgaaaag

SEQ ID NO: 4407 - DNA, 594 bp, Homo sapiens
  misc_feature (137)..(137): n equals a,t,g, or c
tttttctcctgcatttagtaagacagtcatacagttttccatataatgctggattacattggttgatttttgattgtaggaatcctagaccaacttggcatycccagattaaatcttactttgtcatgatgtatttncatgatgaataatccatgttggattattttgttaagaaaatttgcatctgtcgtcatgaatgacattggtctgtacttattttttaccttctaggctatttgtctggttttggattcacggtaatgtgggtctcatagaatgagttggaaaatgtactgccctcttcacttttctggaagagtgtgtgaagaattgaaattttttttttccttttttttttttttgagacggagtctcactccagcccaggcgacagcgggagactccgtctcaaaaaaacaaagagaggaaagaaagaaagaaaagaaggaaggaaggagaaaggaaggaaggaacgaaggaacaaaggaaggaaggaagaggaaggaaggaaggaagaaagagagagagagagaaagaaagaaagaaagaaagaaagaaagaaagaaagaaaaaaaaaaaaaaaaaaccggcacg

SEQ ID NO: 4408 - DNA, 499 bp, Homo sapiens
gggctgcaggaattcggcacgagccaaaacagctttaatgacccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttaccgcttatcttttcttaaaaaaaaaaaaaa

SEQ ID NO: 4409 - DNA, 958 bp, Homo sapiens
ggcacgagccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctcctctctgggacaggctgggaccttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttaaaaaaaaaaaaaaaaaaaaaaaaaaa

SEQ ID NO: 4410 - DNA, 2586 bp, Homo sapiens
  misc_feature (2569)..(2570): n equals a,t,g, or c
ttcggcacgaggcatgcctaagattttcaggacagaagtcaagtgtaaatgatgatatattttgctcttctattagcatcccttttttttctgcttaaagttaaaagtcactttggatgtaaaaatgtaactaccacatcagccaggatttttttaaagccattgtgtactccaaagtctattttccctctgagtagatatggaagaatgagctcctaagagactagcctaatcaaatttaaaagcaaatgtaaatttaaatcaaccatgcagccctgctgtgtggcaattaacatttcaaggtaaaatgaaatgtgatgatagtaaataccagttctacgcagaatcggaaacattctgttccatggtatatttgggcagagaatggaaagttgaaaggaaaaccattattaacacaccaactttgacatttcaagatataattcaaacttgattagaacttccactaaaaataaagtcttctattaaaaaaatcacagtttcccccacctcataggctacatcacagcctctcaaccttggcactctggacattttggactatctaattcttaggggctttcttgtgcattgtgggacgtttaactgcatccctggccctacatactagatgccagtagtaactcaccttcttccatcattgacagctatgaaaatcaaaaatgtctccatataatactgattgaagaatttagggaactgggttactactcactaggcttaccagtccctaactgtgtgttttgtttgtttgtttgttttgggttttttgtggtttcttattcctcccgtatcatatttcaacttaaatatatgaggatttatagtagttttattaagctctaaaatgatctggttgaatcttcctattacttttttaaagggaaaaaacactatttcagagacagaaagtcctcgagggatggtctttgggggataagcagaaggaagtatgatatgaaaaaagggtttaaaattgtttgcagcaaaagcaaaactaccagagccatgcatattttttataagtgtcatccaagagtcggaatttttacagttgttgttggttaccatggatattagtttgaaggacttggaaaagtggaagaggagggttgtgggtagtgggatgatggccataatacatttcctaggagtgttcaagaagtaaaatttacgttctatgtaatttgtataatttttctgaaaagaaaaacttttcaggtaaaacaggtattattatttataccttactgatcaggagctgtatagttctgagttaagtgactcacctaaaattatgatctagcaattacgttggctcaagcttcttttcttctactyagaaagtggaggaaagcatttgccttctgaaggcggaaggctcattgctaatyttcagtgytcacaaaawctgctgctgtggtatttctggggcttctgacaaggacaggaagccacacattggkgaagcatccatgcattggcagcactattgstggataatggagattctaatttaatcagcctgagttagggaaagcacaatacaaatgaacactttgtaaagatgcttgatttgtcatgatcagaacagaatatccaggtagacctggtgcttcttcctttattgkgtttgktcatcctggtccttttctaagacatcagttgctcattgcccctttccccagatcatctgatgkgatkgtgacakgtacmcttggtgkgattgtgattamcaatasctggccagtggscactgctgctgtttgcggcmaactcatcctttcttcctgatgagaatcacttttattggacgttatccttaatcaccagtcaaatgagcctctcttgaaatctggcttctctgtaacctgctgctaccacatttactctattggcatcaaacagggtcgtatatcaatgcaagttaatttcttgaaatctgttaaagaggatgatcttttgctctgtagcatgcagattatgttggtaaacttagtaatacatartaatmcattggagttagcacaggaatagggcaattctgttctttttcttgttgcaaagctaggggacaggtaatttattatacacgtattcaccctgaataggtcagaaccatgaaatttaagaatccttcattggaggctatcaagtcattggggagattaaatctacattgtactttaatctgccggatggccattgccatcagtaaaatgtcggatctgtcggcattgttaatgtaaggggcaccgtctgggtaatcatcaactgaatgcagtgacaagtaattttattgaagtaccaagtaagaacttaaccctcttgatttttttcccttgaacccattttcttacttttgatggaatgaggacatttttagaaaatacagtgagttctatgtcagttttaaacaaaatgtttctcacccttacacctaaatttagttcatctgagaggatatgccaagaagraaagaagaattarcarattaccaaaaaaaaaaagtaattttacaaaatttaaagcacgggctttttccccnngagctaaggaagaatt

SEQ ID NO: 4411 - DNA, 1153 bp, Homo sapiens
  misc_feature (22)..(22): n equals a,t,g, or c
  misc_feature (25)..(25): n equals a,t,g, or c
  misc_feature (77)..(77): n equals a,t,g, or c
  misc_feature (116)..(116): n equals a,t,g, or c
  misc_feature (179)..(179): n equals a,t,g, or c
aatccaaaacaaggggttcggnaanatcaaattgcaaggttaaattttcttggaaaatcttgtttaaagaggatggntcttttggctctgtagcatgcaggattaagtttggtaancttagtaatccatagtaatccattggagttagcacaggaataggccaattctgttctttttcntgttgcaaagctaggggacaggtaatttattatacacggtattcrccctgaataggtcagawccatgaaatttaagaatccttcattggaggctatcaagtcattggggagattaaatctacattgtactttaatctgccggatggccattgccatcagtaaaatgtcggatctgtcggcattgttaatgtaaggggcaccgtctgggtaatcatcaactgaatgcagtgacaagtaattttattgaagtaccaagtaagaacttaaccctctkgattttttycccttgamcccatttycttacttttgatggaatgaggacatttttagaaaatacagtgagtyctatgtcagttttaaacaaaatgtttctcacccttacacctaaatttagttcatctgagaggatatgccaagaagaaaagaagaattaacagattaccaaaaaaaaaaagtaattttacaaaatttaaagcactctctttttctatctttgctaagtcactatttttatagtaatcctttggagtatttacattttgcttctgaacagagagacaaattcttctcccaccacgtatgtactggagtcgtattaatccttgatattgctggaactaacttttcataatagaatatgttctctttcccttttagactgagaatttagtaggtaaaagaagaaatacagattaaactttgagcttcttaaataattcaagatgataggattttacaaaagcttagaagtcagatattaaaaatggaatctgtattctgcagttgttgtataccagtataagcttgatcacaaatttttctgtttataaaatataaaatcacaatttgatacatacgtgtataggcactctattcatgcttaggaaaatataactgtgaagtgaattgtaagtaattttgtaagtacttactatactgatatcagaaaaaaaaaaaaaaaaaaaaaactcgag

SEQ ID NO: 4412 - DNA, 865 bp, Homo sapiens
  misc_feature (344)..(344): n equals a,t,g, or c
ccacgcgtccggcctttcttggccagaggcgccggttggactcacgggcggggcatgatgggtaacaggaccggtggggtccccaggaagtcctagagggggtcggggtttgggtggacaagctttcctcgtcctctcccgacagagctgacgtgtcctgggttccaccgggagcgggcatttccaccggacgggagggttcggggtgtccggggctggggaatacgtaggggttgccgcgcggtgtggggagttggggcgtgtggctgcagtcccgggagttcttggagggggtcggcccaccgagcttccggaccggctgatctgcccgtagcttgccgganggarggcggagctgactctccgtcccttctcccatcccctccagtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtaaaaaaaaaaaaaaaaaaaaaaaaaaaaaaaaaaaaaaa

SEQ ID NO: 4413 - DNA, 2586 bp, Homo sapiens; identical to SEQ ID NO: 4410
  misc_feature (2569)..(2570): n equals a,t,g, or c

SEQ ID NO: 4414 - DNA, 1153 bp, Homo sapiens; identical to SEQ ID NO: 4411
  misc_feature (22)..(22): n equals a,t,g, or c
  misc_feature (25)..(25): n equals a,t,g, or c
  misc_feature (77)..(77): n equals a,t,g, or c
  misc_feature (116)..(116): n equals a,t,g, or c
  misc_feature (179)..(179): n equals a,t,g, or c

SEQ ID NO: 4415 - DNA, 1992 bp, Homo sapiens
  misc_feature (7)..(7): n equals a,t,g, or c
  misc_feature (31)..(31): n equals a,t,g, or c
  misc_feature (42)..(42): n equals a,t,g, or c
  misc_feature (45)..(45): n equals a,t,g, or c
  misc_feature (1977)..(1977): n equals a,t,g, or c
  misc_feature (1992)..(1992): n equals a,t,g, or c
cgggggntaaggggggcatcaacgtactacnctgaacaaaanctncgagctccaccgcggtggcggccgctctagaactagtggatcccccgggctgcaggaattcggcacgaggccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaactcggaggggggmmcsgwacccctttgnccctttggggggccn

SEQ ID NO: 4416 - DNA, 791 bp, Homo sapiens
  misc_feature (27)..(27): n equals a,t,g, or c
  misc_feature (112)..(112): n equals a,t,g, or c
  misc_feature (141)..(141): n equals a,t,g, or c
  misc_feature (185)..(185): n equals a,t,g, or c
  misc_feature (196)..(196): n equals a,t,g, or c
cccatgagtcagcccagacttgggagncgcagccactcagggatccaagggcttcaaccatctgcacccttggccccaggccaagagaccaaacttgcaggctccggatttncggccctgtaggataggctcaaaatgaancatgtttgttatttctaagtggatgggaactgaaagaacccgancaatcagtgtncaaggattcatgaatggaccaaacatgcttgctttttgttcttgaaagatgtttgttgtatttaatatataacgagaagagtggtcaacgctgactgggtgctgagcactttaagtgcattacctgggtggctggctgggctgtgccagggttgaagggtgtggggagcttctttcaaggtgccccttctgcctcctggcacaggactctggctccagcacaccccaagctgaccctggtgggggtagggcccctcacccaaacctggcctctcccgtctcttgttctgctgcctcagctttctcctgtctgtggtagagtctgcttggacagactctgggcaggscaggggscagggcaagctgagaragaattcgttctaggttgatgtgggatgatagtggctggtagggcgcttgtatcctattggaaatccatgatgagatcccattcattcccacccttctcttaacaatgtctccttaagtccaagtctcaagtcgggtgcccagtttcataccatccttsstctccctctcacaaccttcgggcaggaccaaccccctcagaggaacccctgctgccccagcccttt

SEQ ID NO: 4417 - DNA, 560 bp, Homo sapiens
  misc_feature (44)..(44): n equals a,t,g, or c
atagtctacgttawtttamaaggaatatgttaagagaacgagangaataagaaagggtagatcacgtaggagaaaatgctaagaataactccttttcaataatacacgtttcaatgtttatcacagacgtgctcttatgatataaaatgttattttttagtagcaaagataattttggactctgtaatcaaagtgtattggaatttaaattttaaaatgtcaccagactgatgacactggaattcattaaattacttaagattgtatttggtaacagaactactagtgaataatgctagttatattgcttcattaaatatatgtgatctagcttatctatatgaaagatactcaatttaactgcaaaatatattttttataatatttttccagctctatgtagagatatagtctgaattaattaatattattctcttttttttattactctcttacattttaataggttgcagtcaataaaatagccttggccttgaaatgcagtaatcatcacatcatcaaaataaaaacaataatgaaaaaaaaaaaaaaaaactcga

SEQ ID NO: 4418 - DNA, 667 bp, Homo sapiens
gctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcaggtacaggtctttagtgtstggggaggcccttctyccagcacactgccctattccagtgggaggggggcctggggttttcccyttctctccaccatctgtgaaccagctcttgaaagggggtcacttccaacccacctgccatat

SEQ ID NO: 4419 - DNA, 788 bp, Homo sapiens
  misc_feature (717)..(717): n equals a,t,g, or c
  misc_feature (737)..(737): n equals a,t,g, or c
  misc_feature (764)..(764): n equals a,t,g, or c
  misc_feature (777)..(777): n equals a,t,g, or c
  misc_feature (779)..(779): n equals a,t,g, or c
gagttttttttttttttttttttttgagacagagtcttactctgttgcctaggcttgagtgcagtggcacgatctcggctcactgcaacctccgcctcccgggttcaagtgattcttctgcctcagcctcccaagtggctgggactacaggcttgtgccaccatacctggctaactttttatatttttagtagagatggggtttcaccatattgcccaggttggtcttgaactcctggctttgtgatccgccctcagcctcccaaagtactgggattacacacgtgagccactgcgcccagcctggaatgtgcatttttaaagaaaatccaaaaataagattgtgatgtgaaatctcccaattttaaaatgatactaattaatttttaaaattccaacatctgtgagtgaaatatcacccttggtcgtcaggttgtgggcacctgtgtgtgagtcctggcgtaactgagcagggtctggacctggtgggcacgagaggcccggggarggtccttcgggagacagagatagcttcaggtgamagcctgcccccctcctatgamacctccagccatcaggttggggatttgggaaggmaccctgcaggagcttaccatgtaagtcacagttgscactcgtagatgacagcctggcagagagttcaccacactgacagcccatgagaaactccgatttataggccacattaaacaatttnagcattcttggaaccagganaaaggggccatctgagatgtgacaacnccagttcagtcantnttacaattt

SEQ ID NO: 4420 - DNA, 793 bp, Homo sapiens
  misc_feature (7)..(7): n equals a,t,g, or c
  misc_feature (14)..(14): n equals a,t,g, or c
  misc_feature (76)..(76): n equals a,t,g, or c
aaatccncatttcngattgggcaccaggaggagtccccattccaaaccccgggtttgtccatcctccatccatctnactcacaccttagcagggccagttttcatttatttcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatggtaaggctcctgcaggggtgccttccccacatcccccacctgatggctggaggtgtcataggaggggggcaggctgtcacctgaagctatctctgtctcccgaaggacccttcccgggcctctcgtgcccaccaggtccagaccctgctcagttacgccaggactyacacacaggtgcccacaacctgacgaccaagggtgatatttcacttacagatgttggaattttaaaaawtaattaggatcattttaaaaatgggagattyacatyacaatcttatttttggattttctttaaaaa

SEQ ID NO: 4421 - DNA, 906 bp, Homo sapiens
  misc_feature (34)..(34): n equals a,t,g, or c
  misc_feature (833)..(833): n equals a,t,g, or c
ggaaattctccctcactaattggaacaaaagctngagctccaccgcggtggcggccgctctagaactagtggatcccccgggctgcaggaattcggcacgagggaagagagaggggagggtgagcagaggacaggccgggagttttccgggaacggaggaagagcagtggaggctgccaggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtgggcaggagctggttgctgcctcccgggacgctggaccagttcatctgcctgggcagagctcarggcctctcggatgacaacattgtcttcccagatgtgactggargtgccctggacctcarcagcctgccctgggtggcagccccagcctgaccactcagacagccgcggcccccaaggcctgactcttcttgtgggagggcgaggctggtcaccccaggccagcgtctgttgaaggatgaagcagctcctgtccggcccagccctgcctcacagctgtgcgagctctgccctcctcagctctcaaacctgaataaatgcnccaagcccagaaaaaaaaaaaaaaaaaaaaaaaaaaactcgagggggggcccggtacccaattcggaagattg

SEQ ID NO: 4422 - DNA, 696 bp, Homo sapiens
  misc_feature (623)..(623): n equals a,t,g, or c
  misc_feature (652)..(652): n equals a,t,g, or c
gctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcctcaaaaaatgcctgtgcttattactagttcctataaagtgctggaaacccaaatctgtctagcctggggcccctcccccaagatttcaggcctcctgttactcggattacatgttcaggacatctcccntgggatggggcccacaggggaacctttantgtgggaccaaagggggatttgggtcgtcttcaggtcccccttt

SEQ ID NO: 4423 - DNA, 1397 bp, Homo sapiens
gggtcgacccacgcgtccgctgaggtccagagaggggaaggtactacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgtaaaaaaaaaaaaaaaaaaaaaaaaaaaaaaaaa

SEQ ID NO: 4424 - DNA, 979 bp, Homo sapiens
ctcatgtggggagatgagcgtctttctcctgggaccgaagagggaacaagacggagaaggaagaggcggggctgcgactgtscccagcgtactgccgggctgccgggtccctgctctgggtacttctctgctttcgggcgtctcgtctagaagctgcagcttggcctgtctcacctctacacagaggggctgctggcgcctgacggaaaaaggtccacacacccgatggccggcccggggtggacgctgctgctactgctgctgctgctgctgctgctggggtccatggcagggtatgggccacagaagaagttgaacctgtcccataagggcatcggggagccatgcgggagacacgaggagtgccagagcaactgctgtaccatcaacagcctggccccacacacgctctgcacccctaagaccatcttcctgcagtgcctgccctggaggaagcccaatgggtacagatgctcgcacgactcagagtgccagagcagctgctgcgtccgcaacaacagcccgcaggagttgtgcacgccccaaagcgtcttcctgcagtgtgtgccctggcgcaagcccaacggcgacttctgcagcagccatcargagtgtcacagccagtgctgcatccagctgagggagtacagccccttccgctgcattccccggaccgggatcctggcccagtgcctgcccctgtgatgtgagctcgaacctgggcgcgagggaccggcctgggccctgggatgttcacgcaggaccgcgttgcgcgggggctggttccagcggaagcttcccttacggtttgtgctgctgtttctggggctctgaaaatctgtgggaactgaaaggctgtgaccagcctggtggcgcgaagtgtctgtgagaacaaatcccaggcactggggtgtagcctgattgttaaacatcmataaaggctcctggccgactgaaaaaaaaaaaaaaaaaaactcga

SEQ ID NO: 4425 - DNA, 1821 bp, Homo sapiens
ggcacgagatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggtaagaaagtggtcattcttctttccttagacatttgctgttattattaggttggtggaaaagtagttgcggtttttgccattaaaagtaatgaccaaaatcgcaattatttttgcaccaacttaatactttacatttgtagtagtcatcattaaacaggcctcgtaactaaaaacagaatcttcgggttaaaagaggcctcaaaggtcacgtagttcaatttctcacccagggccagtcttttctaccacatgcagtcactgcttgagcacttgtagtgatggggaactgactacctgaaaacagctcactcaattgtttaacacttccagttgttggaaagttctaaagcatatcaacagctaaccattattaagcacatattgtgtgctgggtattgtgttaagtgcttgtatgtgttttcccttaaatactctctgtaatcccttgaggccaggttagtatctccattttttagagcaggaaacagagatgtacagtttcttgttcaggctcactcaggtggtggtggaacaggaatggaccccatgcagttggcctgcagcctgtgctcccctatgctcctctccattcaggagcctccaagagtttgcagaatggccccctaggcagtggaaggcagcaggcttggctctcccatccccaaggggcctcactatgaagaagctaagtaatggacgataggaatgtattctgtattctgctgaaaagacaaatgtattctgctgaaaagacaatcttgcacacacgaagaacagtgtaaattaaaaccaaaccaaaggctgggtgtggcggctatgcctgtaatcccagcactttgggaggctgaggtgggcagattgcttgagattaggagtttgagcctgggcaacatagtgaaaccctgtctttataaaaaatacaaaaattagccagacatagtggtgcacatctgtagttccagctactcaggaggctgaggtaggaggattgcttgagccagggaggtggaggttgcagtgagctgaaattgcaccactgcactccatcctgggtgacagaacaagaccctgtctcaaagaaaaaaaaaaaaaaaaaa

SEQ ID NO: 4426 - DNA, 2427 bp, Homo sapiens
  misc_feature (17)..(18): n equals a,t,g, or c
  misc_feature (33)..(33): n equals a,t,g, or c
  misc_feature (2279)..(2279): n equals a,t,g, or c
  misc_feature (2350)..(2350): n equals a,t,g, or c
  misc_feature (2369)..(2369): n equals a,t,g, or c
  misc_feature (2394)..(2394): n equals a,t,g, or c
  misc_feature (2416)..(2416): n equals a,t,g, or c
ccgattcattaatgcanntggcagacaggtttnccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaaaaaaaaaaaaaaaaaaastcgagggggggcccggtacccaattcgccctatagtgagtcgtattacaattcactggccgtcgttttacaacgncgtgactgggaaaaccctggcgttacccaacttaatcgccttgcagcacatccccctttcgccagctggcntaatagcgaagaggcccgnaccgatcgcccttcccaacagttgngcagcctgaatggcaaatggcnaattgtaagcg

SEQ ID NO: 4427 - DNA, 491 bp, Homo sapiens
  misc_feature (2)..(2): n equals a,t,g, or c
  misc_feature (5)..(5): n equals a,t,g, or c
  misc_feature (10)..(10): n equals a,t,g, or c
  misc_feature (15)..(15): n equals a,t,g, or c
cntcncattngggancctcaaagatttgcagaatggccccctaggcagtggaaggcagcaggcttggctctcccatccccaaggggcctcactatgaagaagctaagtaatggacgataggaatgtattctgtattctgctgaaaagacaaatgtattctgctgaaaagacaatctwgcacacacgaagaacagtgtaaattaaaaccaaaccaaaggctgggtgtggcggctatgcctgtaatcccagcactttgggaggctgaggtgggcagattgcttgagattaggagtttgagcctgggcaacatagtgaaaccctgtctttataaaaaatacaaaaattagccagacatagtggtgcacatctgtagttccagctactcaggaggctgaggtagggagctgacagggaggtggaggttgcagtgagctgaaattgcaccactgcactccatcctgggtgacagaacaagaccctgtctcaaagaa

SEQ ID NO: 4428 - DNA, 2636 bp, Homo sapiens
  misc_feature (632)..(632): n equals a,t,g, or c
  misc_feature (887)..(887): n equals a,t,g, or c
tgctgcaggaattcggcacgagggcaatccgggcttgcagacgaggtaaggtcgattccatttggcccggggatggtcacacgcgcgggggccggaactgccgtcgccggcgcggtcgttgtcgcattgctctcggccgcactcgcgctgtacgggccgccactggacgcagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggtgngtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagcgcaggtgtggagggnaaggggacctcctgtcgggctccctgggcgtcctggtacactgggcgctscttgctggaccacagawaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcrtctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaaaaaaaaaaaaaaaaaaaaaaaaaaaaattcctggggccgcgaattctt

SEQ ID NO: 4429 - DNA, 2636 bp, Homo sapiens
tgctgcaggaattcggcacgagggcaatccgggcttgcagacgaggtaaggtcgattccatttggcccggggatggtcacacgcgcgggggccggaactgccgtcgccggcgcggtcgttgtcgcattgctctcggccgcactcgcgctgtacgggccgccactggacgcagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggtkggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagcgcaggtgtggagggsaaggggacctcctgtcgggctccctgggcgtcctggtacactgggcgctscttgctggaccacagawaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcrtctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaaaaaaaaaaaaaaaaaaaaaaaaaaaaattcctggggccgcgaattctt

SEQ ID NO: 4430 - DNA, 2636 bp, Homo sapiens; identical to SEQ ID NO: 4429

SEQ ID NO: 4431 - DNA, 2636 bp, Homo sapiens; identical to SEQ ID NO: 4428
  misc_feature (632)..(632): n equals a,t,g, or c
  misc_feature (887)..(887): n equals a,t,g, or c

SEQ ID NO: 4432 - DNA, 725 bp, Homo sapiens
  misc_feature (642)..(642): n equals a,t,g, or c
  misc_feature (694)..(694): n equals a,t,g, or c
gttctaaaatatgacccccgggctgcaagaattcgcacaggaaaattggcagcgggggctgatggaagtgcagtgggggctggagagggcaccctagtgagttggcttttctctccttcggtgcctttggttgggctcgaggcccggggtcggaggccatcaggacaagagtgtgggacttggaagggcagccacctggagcttggaaggggctgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacggccctggcactgaacttcggctctacgttgatgaagaagaagtctgatcctgagggtcacgcgctgctcttccctgagaggattcatcngatagacaagagtgagaatggtgaggcatatcagagaaagaaggcggcagcnactggccttccagagggtcctgctgtcccct

SEQ ID NO: 4433 - DNA, 645 bp, Homo sapiens
cccccccccccccccaagactgcaatgacaaatgctcacacaacaccgaggtcggggagacgcggagcagaactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaaaaa

SEQ ID NO: 4434 - DNA, 1080 bp, Homo sapiens
  misc_feature (514)..(514): n equals a,t,g, or c
  misc_feature (721)..(721): n equals a,t,g, or c
ccgatgtggacatcatcctgtctatccccatgttcctgcgcctgtacctgatcgcccgagtcatgctgctgcacagaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaagtcctgaatcaccagcccagccttctggctcatcacttcctgcttggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataanttcatgatggacactcagctcaccaagcggatcaagaatgytgcagccaatgtccttsgggaaacatggttaatctataaacacacaaagytgytaaagaagattgaccatgccaaagtgaggaacaccagaggaagttcytccaagtatccaccagttgaggagcgtcaagatggaacagaggaagctgagtgaccaagccaacantctggtggacctttccaagatgcagaatgtcmtgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattaaaaaaaaaaaaaaaaa

SEQ ID NO: 4435 - DNA, 1114 bp, Homo sapiens
gggcagacgatgctgaagatgctctcctttaagctgctgctgctggccgtggctctgggcttctttgaaggagatgctaagtttggggaaagaaacgaagggagcggacaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaaggttggctttttaaattttatttatttttgtgctggctacgttaattttattttagtgttaccttcctcactgaaggtatttctttgtaataaaagaaagaatcttgcaggagaaaataagggggcaacataagaaacaataattatggcacctgaattaggacagtgacattaaakgttggctktttawattttaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4436 - DNA, 1989 bp, Homo sapiens
  misc_feature (31)..(31): n equals a,t,g, or c
  misc_feature (161)..(162): n equals a,t,g, or c
  misc_feature (1702)..(1702): n equals a,t,g, or c
  misc_feature (1943)..(1943): n equals a,t,g, or c
ttaaatgaaatcaaaattggccatttgacanaagttggtttttcccctttctgcatttttaggacctcaaagtaatgtttatccagaaactgctatcattaccagggattcattcgtgtatttaacaacatggggcatacattttggccaaatttgaaaanntcttaacatacaccccaaaatccctgccccaaatttaagaactagggtggacacagtgcgtttttccatgtcgcatcttctgtgatggggctacgatacgtgggagcagagaatggggaggttggagcgcatgccagatgaggatctatcagcaatgggacgggkcctccactttagcatctcyaccctgctcctytcagaggaccgcctttcattgcattcagctgtgatggtagcacgaacacaggtgcaccgaggacgaggagagcaggagccttgtgctctctctgcatctgaggcaggacagcacagggtayggagcagtctgcagagaggccagctcatcagggaagcacttgtcttccaccttgggctttgactgagcactgggcaattggmcyctggggatcaaygaaataatcctaarcagagttactctatgtcacactatggaatgttccaagtasrtggccgtgttttcaaaagatrtattttctccttttgttgttgccatttcataggtttaggattgggtgtgtgtktctcctctctgaatggcactcraatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactamacaagcactgagctgattgttgagccagaggagccctcagacagcagtggcatcaacttgtcaggctttgggagtgagcagctagacaccaatgacgagagtgatkttatcagtacactaagttacatcttgccwtatttctcagcrgtaaacctagatgtgraatcamtgttactaccgttcattaaactgccaaccmcaggaaacagcctggcaaagattcaaactgtaggccaaaaccrgcararagtgaakagagtcctcatgggcccaaggagcatccagaaaaggcacttcaaagaggtrggaaggcagagcatcaggagggaacagggtgcccaggcatctgtggagaacgctgccgaagaaaaaaggctcgggagtccagccccaagggagstggaacagccycacacacagcaggggcctgagaagttagcgggaaacgccrtctacaccaagccttcsttcacccaagagcataaggcagcagtctctgtgctgamacccttctccaagggcgcgccttctacctccagccctgcaaaagccctaccacaggtgagagacagatggaaagacwwmacmcacrctatttccattttagaaagtgcaaaggctagagttacaaatatgaaggcttctaaaccaatttcacattccagaaaaaaataccgctttcacaaaactcgctcccgcatgacccacagaacacccaaggtcaaaaagagtccaaagttcagaaagaaaagttatctgagtagactgatgctcgcaaacaggcctccgttctctgcagcgnagagcctcataaattccccttcacaaggggctttttcatccttaggagacctgagtcctcaagaaaacccttttytggragtatctgctccttcagaacattttatagaaaccactaatataaaagacacaactgcaagaaatgccttggaagaaaatgtttttatggaaaacactaacatgccagaagtcaccatctctgaaaacacaaactacaatcatcctcctgaggcagattccgntgggactgcattcaacttagggccaactgttaaacaaactgagaca

SEQ ID NO: 4437 - DNA, 2320 bp, Homo sapiens
ggcacgagtttgtctcagtttgtttaacagttggccctaagttgaatgcagtcccagcggaatctgcctcaggaggatgattgtagtttgtgttttcagagatggtgacttctggcatgttagtgttttccataaaaacattttcttccaaggcatttcttgcagttgtgtcttttatattagtggtttctataaaatgttctgaaggagcagatacttccagaaaagggttttcttgaggactcaggtctcctaaggatgaaaaagccccttgtgaaggggaatttatgaggctcttcgctgcagagaacggaggcctgtttgcgagcatcagtctactcagataacttttctttctgaactttggactctttttgaccttgggtgttctgtgggtcatgcgggagcgagttttgtgaaagcggtatttttttctggaatgtgaaattggtttagaagccttcatatttgtaactctagcctttgcactttctaaaatggaaatagtgtgtgtgttgtctttccatctgtctctcacctgtggtagggcttttgcagggctggaggtagaaggcgcgcccttggagaagggtgtcagcacagagactgctgccttatgctcttgggtgaacgaaggcttggtgtagatggcgtttcccgctaacttctcaggcccctgctgtgtgtgaggctgttccagctcccttggggctggactcccgagccttttttcttcggcagcgttctccacagatgcctgggcaccctgttccctcctgatgctctgccttcccacctctttgaagtgccttttctggatgctccttgggcccatgaggactctattcactttttgctggttttggcctacagtttgaatctttgccaggctgtttcctgtggttggcagtttaatgaacggtagtaacattgattccacatctaggtttactgctgagaaatatggcaaatgtaacttagtgcactgataacctcactctcgtcattggtgtctagctgctcactcccaaagcctgacaagttgatgccactgctgtctgagggctcctccggctcaacagtcagctcagtgcttgtgtaattcttccgggcttgtaacgtcttcatgaatgctccttctggattccctacagattcttcttcagctgtcaaaaaagagactgctttgctcatgaaagatgatgggatgggatgcatcagtccatagctgtacaccccagtcacacagagtaggagtcagcaaacatttgagtgccattcagagaggagacacacacacccaatcctaaacctatgaaatggcaacaacaaaaggagaaaatatatcttttgaaaacacggccatctacttggaacattccatagtgtgacatagagtaactctgcttaggattatttcattgatccccagggtccaattgcccagtgctcagtcaaagcccaaggtggaagacaagtgcttccctgatgagctgatgagctggcctctctgcagactgctccataccctgtgctgtcctgcctcagatgcagagagagcacaaggctcccgctctcctcgtcctcggtgcgcctgtgttcttgctaccatcacagctgaatgcaatgaaaggcggtcctctgagaggagcagggtggagatgctaaagtggaggccccctcccattgctgatagatcctcatctggcatgcgctccaccctccccattctctgctcccacatatcgtagccccatcacagaagatgcgacatggaaaaaagcactgtgtccaccctagttcttaaatttgggcagggatttggggtgtatgttaagagtttttcaaatttgccagattggatgcctatgttgttaaatacacagtgaatctctggtatgatagcagtttctggataaacattacttgaggtcctaaaatgcagaagggaaaaagcaacttttgtcagatgcctactttgctttcatttcatctctaatattttggatggggaatcagccaaagcttctgactgcatgaaggtcaagtgtgccagtgtgcagctgggtttcttttccagaattaaaagtattttgggtggtggtgagggtcagaggaagaagtaaagattgtgagaaagtggaagaagcatgggcttggggagaacccagaattggggccagaagacctggcactaggctacagcacttagcacctctgatcttgtttttcttcatctgtaaaaggaggttaacaaagcttttctgcccacttcttggggagaagggaataatataattggtaaaaaaaaaaaaaaaaa

SEQ ID NO: 4438 - DNA, 3147 bp, Homo sapiens
tttttatgggaattaaaaaattaaaaaaactgaaacttgtgaaaaaaaatgttatttaattgtaaaatctccaccccctgagcatatgttttcaggtctgggtgactaattagactgggaaacaagggcaggaacgatggccctgtgcttgctctgcccgctgcctctgtggatgtgtgggccgctggcttcagtcctgcttttttgatggccgttgtttacgctatgtatttttgcaggaggcctgaggtgggctgggttctcctcctatggcagggcttcactctcctcctccgttggggcttcgctgtcccttgagaatccttcttcatcttcttgtaatgaccttcggtgacaacagatctcaatgaggcagagaagtataatcaaaatcgttagtattccagtcacaattaacgccaagatgagttttttggtatagccatatcctggaagttcttttgtgaactcaagcgacttctctttctgttcactctgggcttctgtgctctcattaatgtagttctcagtcttccattggtccgtatcccattctatcttggatgcctttacttcctgctgcccactgagaagcttcatcaggtggcctgtcctggagacgagcttggcacaggtcacttgcacatgggccccagagcagtccatcttcaaggtccggataacatgagcaatgagccttctcacattgttgttggggataagggactgtagctgctgggttagctgaatttcaaactgatcacctggggacgagagcaatgggtaattgaagcttttgggctcgggggacaggtcagtgcccacgttgttgtattcccattttgtctcagtttgtttaacagttggccctaagttgaatgcagtcccagcggaatctgcctcaggaggatgattgtagtttgtgttttcagagatggtgacttctggcatgttagtgttttccataaaaacattttcttccaaggcatttcttgcagttgtgtcttttatattagtggtttctataaaatgttctgaaggagcagatacttccagaaaagggttttcttgaggactcaggtctcctaaggatgaaaaagccccttgtgaaggggaatttatgaggctcttcgctgcagagaacggaggcctgtttgcgagcatcagtctactcagataacttttctttctgaactttggactctttttgaccttgggtgttctgtgggtcatgcgggagcgagttttgtgaaagcggtatttttttctggaatgtgaaattggtttagaagccttcatatttgtaactctagcctttgcactttctaaaatggaaatagcgtgtgtgtgtctttccatctgtctctcacctgtggtagggcttttgcagggctggaggtagaaggcgcgcccttggagaagggtttcagcacagagactgctgccttatgctcttgggtgaacgaaggcttggtgtagacggcgtttcccgctaacttctcaggcccctgctgtgtgtgaggctgttccagctcccttggggctggactcccgagccttttttcttcggcagcgttctccacagatgcctgggcaccctgttccctcctgatgctctgccttcccacctctttgaagtgccttttctggatgctccttgggcccatgaggactctattcactttttgctggttttggcctacagtttgaatctttgccaggctgtttcctgtggttggcagtttaatgaacggtagtaacagtgatttcacatctaggtttactgctgagaaatatggcaaatgtaacttagtgtactgataaaatcactctcgtcattggtgtctagctgctcactcccaaagcctgacaagttgatgccactgctgtctgagggctcctctggctcaacaatcagctcagtgcttgttagttcttccgggcttgtaacaccttcatgaacgctccttctggattcccgaccgatgcttcttcagctgtcaaaaaagaagagactgctttgatcatgaaagatgatgggatgggatgcatcagtccatagctgtacaccccagtcacacagagtaggagtcagcaaacattcgagtgccattcagagaggagaaacacacacccaatcctaaacctatgaaatggcaacaacaaaaggagaaaatacatcttttgaaaacacggccacctacttggaacattccatagtgtgacatagagtaactctgtttaggattatttcgttgatccccagaggccaattgcccagtgctcagtcaaagcccaaggtggaagacaagtgcttccctgatgagctggcctctctgcagactgctccgtaccctgtgctgtcctgcctcagatgcagagagagcacaaggctcctgctctcctcgtcctcggtgcacctgtgttcgtgctaccatcacagctgaatgcaatgaaaggcggtcctctgagaggagcagggtggagatgctaaagtggaggccccgtcccattgctgatagatcctcatctggcatgcgctccaccctccccattctctgctcccacgtatcgtagccccatcacagaagatgcgacatggaaaaacgcactgtgtccaccctagttcttaaatttgggcagggatttggggtgtatgttaagagtttttcaaatttgccagattgtatgcctatgttgttaaatacacaatgaatccctggtatgatagcagtttctggataaacattacttgaggtcctaaaatgcagaagggaaaaagcaacttttgtcagatgcctactttgctttcatttcatctctaatattttggatggggaatcatccaaagcttctgactgcatgaaggtcaggtgtgccagtgtgcagctgggtttcttttctggaattaaaagtactttgggtggtggtgagggtcagaggaagaagtaaagattgtgagaaaggggaagaaacatgggcttggggagaacccagaattggggccagaagacctggcactaggctacagcacttagcacctctgatcttgtttttcctcatctgtaaaaggaggttaacaaagcttttctgcccacttcttggggagaagggaataacataattggtaaaaaaaaaaaaaaaaaa

SEQ ID NO: 4439 - DNA, 1989 bp, Homo sapiens; identical to SEQ ID NO: 4436
  misc_feature (31)..(31): n equals a,t,g, or c
  misc_feature (161)..(162): n equals a,t,g, or c
  misc_feature (1702)..(1702): n equals a,t,g, or c
  misc_feature (1943)..(1943): n equals a,t,g, or c

SEQ ID NO: 4440 - DNA, 996 bp, Homo sapiens
  misc_feature (584)..(584): n equals a,t,g, or c
cgcctggcaccatgaggacgcctgggcctctgcctgtgctgctgctgctcctggcgggagcccccgccgcgcggcccactcccccgacctgctactcccgcatgcgggccctgagccaggagatcacccgcgacttcaacctcctgcaggtctcggagccctcggagccatgtgtgagatacctgcccaggctgtacctggacatacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccnggaacctcctttgagcatagagttagcaaccatgcttctcattcccttgactcatgtcttgccaggatggttagatacacagcatgttgatttggtcacctaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttaygtagtgctgacaggacccactctttcattgaaaggtgatgaaaatcaaataaagaatctcttcacatgaraaaaaaaaaaa

SEQ ID NO: 4441 - DNA, 1041 bp, Homo sapiens
tcgacccacgcgtccgcccacgcgtccgcccacgcgtccgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcagagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagcaagctcctccaaccacaaggggggtggggggcggtgaatcacctcygaggcctgggcccagggttcaggggaacttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaaaaaaaaaaaaaaaaagggcggccgctctagaggatccctc

SEQ ID NO: 4442 - DNA, 864 bp, Homo sapiens; identical to SEQ ID NO: 69
  misc_feature (28)..(28): n equals a,t,g, or c
  misc_feature (706)..(706): n equals a,t,g, or c
  misc_feature (745)..(745): n equals a,t,g, or c
  misc_feature (748)..(748): n equals a,t,g, or c
  misc_feature (757)..(757): n equals a,t,g, or c
  misc_feature (765)..(765): n equals a,t,g, or c
  misc_feature (772)..(772): n equals a,t,g, or c
  misc_feature (781)..(781): n equals a,t,g, or c
  misc_feature (813)..(813): n equals a,t,g, or c
  misc_feature (840)..(840): n equals a,t,g, or c
  misc_feature (842)..(842): n equals a,t,g, or c

SEQ ID NO: 4443 - DNA, 941 bp, Homo sapiens
ggcacgagcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaaccygctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgytaagacaaaaagtaaagcactgtggtctttgcaaaaaaaaaaaaaaaaaaaaaaaaaaaaaaaaaaaaaaaaaaaaaaaaaaaaaaactcga

SEQ ID NO: 4444 - DNA, 654 bp, Homo sapiens
  misc_feature (651)..(651): n equals a,t,g, or c
gaattcggcacgaggcagcttgtgctttaaaggaggtgttcaaagcatgtctgagcagagacttttgggctctgttttaattaatactttaaaataattcatatttaaaatatcaratgtttccataaagaggaggatgtttaaatgcctccagactacattcctttttattscttgattttacctgggagtccaaagttcaattcccataaagcaagcgttttatttgtcactttcaatatacatccgattgccatgcttaagatgcaatatgggctgcggaaataggttaacccacaggctcccagggcccagtgtagaaggtgagagattcgtgtaaaatgattcaaataaaaggaagaccctggccgggtgccgtarctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgtcagtgagctgagatcgcgccacagcactccagcctgggtgacagggtgagactctgtctcaaanaga

SEQ ID NO: 4445 - DNA, 1448 bp, Homo sapiens
  misc_feature (1441)..(1441): n equals a,t,g, or c
tcgacccacgcgtccggaacgtgctccgcgggctcagtccgcccgccgctgcgtccgcggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctaacaaacaaggctttgccatccccggttccagtttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctgggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaagtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaanaaaaaaa

SEQ ID NO: 4446 - DNA, 852 bp, Homo sapiens
  misc_feature (719)..(719): n equals a,t,g, or c
  misc_feature (834)..(834): n equals a,t,g, or c
  misc_feature (840)..(840): n equals a,t,g, or c
gaattcggcacgagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatatncccaccccccaccccttgttttgctcttaatggttttttccttgggtggggatagtatacactgtactaagaaatgtcattcaataaatacgttttgagtgctgtctaaaaaaanaaaganttggtggggggg

SEQ ID NO: 4447 - DNA, 423 bp, Homo sapiens
  misc_feature (15)..(15): n equals a,t,g, or c
  misc_feature (74)..(74): n equals a,t,g, or c
aatgaatagagacanagagatttgggggaaaacaaatggaacttcaagaaataaaaagtattatctcaagttgnatgtggtggctcatgcctttaatcctagtgactcaagaggctgaggcgggaggatcacttgaggccaggagtttgagaccaccctgggcaacatagcaagacccctgtctctataaaaatcaaaaaaattagccaggcatggtggggcacacctgtagttccagctacttgggaggctgaggcgggaggattgcttgagcccaggcgtttgcggctgcagtgagccgtagtcactccactgcactcaagcctgagtggcagagcaagaccttgtctctactaaaaaaaaaaacataaaaaactctcaaaatctaaaattcaacaaacaaacagttgaaggcagattcaa

SEQ ID NO: 4448 - DNA, 429 bp, Homo sapiens
  misc_feature (14)..(14): n equals a,t,g, or c
  misc_feature (125)..(125): n equals a,t,g, or c
ccctgggcaacatngcaagacccctgtctctataaaaatcaaaaaattagccaggcatggtggggcacacctgtagttcccagctactgggaagcctgaagccggaagattgcttgacccaggcnttgcggctgcagtgaccgtagtcactcaatgcaattaagcctgagtggcagagcaagactttgtctctactaaaaaaaaaccataaaaactctcaaatctaaattcacaacaacagttgaatagagaattaattagcccagcgtggtggcatgtgcctgtagtcccagctactcaggaagctaaggtgggaggatggtttgagcctgggaggcagagtttgcagtgagccgagattgcaccactgcaccccagcctgggtgatagggccaggccttgtcttaacaacaacaacagaaaaaaaaa

SEQ ID NO: 4449 - DNA, 1044 bp, Homo sapiens
  misc_feature (16)..(16): n equals a,t,g, or c
  misc_feature (22)..(22): n equals a,t,g, or c
  misc_feature (1039)..(1039): n equals a,t,g, or c
  misc_feature (1041)..(1041): n equals a,t,g, or c
gacttccggggagcantttggntgaatggaccctgcagagcagaggcctggaggcgcctccccggggctggtctgtgtcactgtactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgmcgcagccaccgcttcccagcctggatgcagggcagctggccgtccagcagcagaactttatccagcagcaggcgctaatcctggcccagcagatgacagcccaggccatgtccctgtccctggagcagcagacgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcngnagg

SEQ ID NO: 4450 - DNA, 3300 bp, Homo sapiens
tcgacccacgcgtccggtgagaggcaaggacttttcatctttagggcattctgaccacgtcctgcttcagagagattgttcccggcgtctcagtgctatggggagcaggttcctcctggtcctgctctcaggtctcactgtcttactggctctgccaggatcagaagccaagaattctggagcttcctgtcctccatgccctaaatatgccagctgccacaacagcacccactgtacttgtgaagatggctttcgggccaggtctggcaggacatactttcatgattcctctgagaagtgtgaagatattaatgaatgtgaaaccgggctggcaaagtgcaagtataaagcatattgtaggaataaagttggaggttacatctgtagctgtttggtaaaatatactttattcaactttctggctggtattatagattatgatcatccggattgttatgagaacaatagtcaagggacgacacagtcaaacgtggatatttgggtgagtggggtgaagcctggatttgggaaacagctggtacgtataactatgccattttcctacccaaacattaacatgtcttcctgtgatttttagggtagggtagttctatccaggggtaattttgtcctctgtcccaaggtcatctgtcaatgactggggacacttttggttgtcataccttgggggtgatgtgtgtgactggcatctggtggatggagaccagggatacagctcaacatcctacagtgcccaggacagcctcccacaatcaagaagtgcctagtgccatatgtccatagagatagagaaatacaagtgtagggggaaagtgcctcagctggcattcaaagacctacatcaagcacctagattctcaatgccacacgcaccttgtagcaccttaataaatatcgttgccttctgggctccccactccaacacttgtgcatattccctatttcttacatttcagtaagagtcaatctaattagcttaatttttttggaaggaaaatctgagaagaaatggaagcagagaggactttgcaagaagggctactcaactaattcaaagcgtggagttgagcatctggaatgcgagttttgcttctccaggaaagggtcaaatttctgaatttgatatagtctatgaaaccaagaggtgcaatgagacaagggagaatgcttttctggaagctggaaataacaccatggatatcaactgtgctgatgctttaaaaggaaacctaagagagagcactgcagttgccctatcacttatcaatctcttggggatattctgaatgcatccttttttagtaaacgaaaagggatgcaggaagtaaaactgaactcttacgttgtgagcggcaccatcggtttgaaggaaaaaatttccctctctgaacctgtgttcctgacttttcgccataatcagcctggtgacaagagaacaaaacatatctgtgtctactgggagggatcagagggaggccgctggtccacggagggctgctctcatgtgcacagcaacggttcttacaccaaatgcaagtgcttccatctgtccagctttgccgtcctcgtggctcttgcccccaaggaggaccctgtgctgaccgtgatcacccaggtggggctgaccatctctctgctgtgcctcttcctggccatcctcaccttcctcctgtgccggcccatccagaacaccagcacctccctccatctagagctctccctctgcctcttcctggcccacctcctgttcctgacgggcatcaacagaactgagcctgaggtgctgtgctccatcattgcagggctgctgcacttcctctacctggcttgcttcacctggatgctcctggaagggctgcacctcttcctcaccgtcaggaacctcaaggtggccaactacaccagcacgggcagattcaagaagaggttcatgtaccctgtaggctacgggatcccagctgtgattattgctgtgtcagcaatagttggaccccagaattatggaacatttactcactgttggctcaagcttgataaaggattcatctggagcttcatggggccagtagcagtcattatcttgataaacctggtgttctacttccaagttctgtggattttgagaagcaaactttcctccctcaataaagaagtttccaccattcaggacaccagagtcatgacatttaaagccatttctcagctatttatcctgggctgttcttggggccttggtttttttatggttgaagaagtagggaagacgattggatcaatcattgcatactcattcaccatcatcaacacccttcagggagtgttgctctttgtggtacactgtctccttaatcgccaggttcgaatggaatataaaaagtggtttagtgggatgcggaaaggggtagaaactgaaagcactgagatgtctcgctctactacccaaaccaaaacggaagaagtggggaagtcctcagaaatctttcataaaggaggcactgcatcatcatctgcagagtcaaccaagcaaccgcagccacaggttcatctcgtctctgctgcttggctaaagatgaactgacctggcaagtgccatggcaatgacccggaagttacccctcctttccgtttgtctacagcgcccctgtggtcacacatagattggacaaatgccactatttctagctttcctgtgaaaagtctaggctcattcacctattttggctttttatgttcatagaaagaacaagacatttgggagaattcttagatccagagtccagtagtgtggcacgtgcaatgaagtgtcggaaggatgcattttaaagatggcgggcgggagaagtggattttcttcttgcagctactgccaccttgccagaaactcactaactggcatctggattcagctcatagttccctttctggcctctctgctgtattttatgctcccaaagatcttacattaacactccacattcacataattcaacaattttcatatggatcagtattaaagagggtgttgcattttgcaatacaaaaatgcattatcaggtgctggagaggatgtggagaaataggaacacttttacactgttggtgggactgtaaactagttcaaccatcgtggaagtcagtgtggcgattcctcagggatctagaactagaaataccatttgacacagctatcccattactgggtatataccccaagggctataaatcatgctgctataaagacacatgcacacgtaaaaaaaaaaaaaaagggcggccgct

SEQ ID NO: 4451 - DNA, 2311 bp, Homo sapiens
  misc_feature (654)..(654): n equals a,t,g, or c
  misc_feature (2293)..(2293): n equals a,t,g, or c
tcgacccacgcgtccgcttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcasasctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggnggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggcaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcrggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataaataaagctcccattcttacccttaaaaaaaaaaaaaaagggcggccgctctagaggatccaagcttacgtacgcgtgcatgcgacgtcatanctcgtctataggaactgg

SEQ ID NO: 4452 - DNA, 1781 bp, Homo sapiens
  misc_feature (1494)..(1494): n equals a,t,g, or c
  misc_feature (1496)..(1496): n equals a,t,g, or c
gctgggtgccatggcggcagcggcggtgacaggccagcggctgagaaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcascagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctancncgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgaaaaaaaaaaaaaaaaaaattggggggggggcccggtaacccatttggccctttag

SEQ ID NO: 4453 - DNA, 1402 bp, Homo sapiens
  misc_feature (68)..(68): n equals a,t,g, or c
ttccaaagctggagctccaccgcggtggcggccgctctagaactagtggatcccccgggctgcagganttcggcacgaggagaaccagagggcgaagtgggagggcacaggggagactaaaaaggccagggaagttggcctgccggaagttcccagggagaaggcagcgcgttgtacccgagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttcttcaacaagggaagttaaattttgagacttttttccccaaaggatactgactgtaatacaattaccaattcacaatgataaaaatattttgaaaggttaaaaaaaaaaaaaaaaaaaaatgaccctcgagggggggcccgg

SEQ ID NO: 4454 - DNA, 608 bp, Homo sapiens
  misc_feature (10)..(10): n equals a,t,g, or c
  misc_feature (16)..(16): n equals a,t,g, or c
ccatacgcanaccgcntctccccgcgcgttggccgattcttatggcagctggcacgacaggtttcccgatggaaagcgggcagtgagcgcaacgcaattaatgtgagttagctcactcattaggcaccccggctttacactttatgcttccggctcgtatgtkgtgtggaattgtgagcggataacaatttcacacaggaaacagctatgaccatgatttacgccaagctcgaaattaaccctcactaaagggaacaaaagctggagctccacgcggtggcggccgctctagaactagtggatcccccgggctgcaggaattcggcacgagtttgggtggagtttccaaggtgaaagtttctgaattggtcaatcagtgacgcctttgtaaagatggctcatgtggtggtcgctcgcaatgaatgcctgataagggcttttctgtttcttttgcactgtgtaagtttgctcccatcgcctggggaagttaatatcagacacacactttttacggtagaagagaggttgactactccaagggcactgaaactctcactgagccttattgtttctctacacgcgamttgcagaaagcaggagtgctcgta

SEQ ID NO: 4455 - DNA, 1512 bp, Homo sapiens
  misc_feature (1359)..(1359): n equals a,t,g, or c
  misc_feature (1466)..(1466): n equals a,t,g, or c
  misc_feature (1478)..(1478): n equals a,t,g, or c
ggaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagargcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtwtcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacacccagattccattaaaaattctgctaatcgacacaacacatatatttgctcatgatttcacttgacagcgtatgctccttggcctctaattgtactttgcttttccagagccctttttacctggggatttcagtgtgcttaagtaaaatcctctgaaaaccacgggagcctctgcctcctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgtcctgtaacagacaatcccatgtcctaggtatggntttttattctggtagtgcttcgggaaagtaagtgattcatttgaataaggcaaattaggagaaagcccaggttggggtgaaatcagacttaacagatacatgctggntctccttgctgngtgtgacacagcagacagaggcactattcctggg

SEQ ID NO: 4456 - DNA, 2598 bp, Homo sapiens
  misc_feature (80)..(80): n equals a,t,g, or c
  misc_feature (1123)..(1123): n equals a,t,g, or c
  misc_feature (1495)..(1495): n equals a,t,g, or c
  misc_feature (2004)..(2004): n equals a,t,g, or c
  misc_feature (2019)..(2019): n equals a,t,g, or c
  misc_feature (2036)..(2036): n equals a,t,g, or c
  misc_feature (2595)..(2595): n equals a,t,g, or c
ctacctttggtcctgggaaaccttccctaaaatcctctgaaaaccacgggagcctctgcctcctcagccacagtgaattncctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttctgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactycaagctccttgaaagtaggacctttgtgagccacgcctttcattcttcaacagtgccttgcatgtaacaagcactccagaaatgtttgttgaatgaatgaatggkgkcatgggtgaatgatggggagkaaatttaggaaggggaagtgagagagtatggnggcaatatcacaagggaggagagaggaaaacaattatcttctctacttggattatgaagataaccttttcttggaggaaagaaacaccgctttacaaaggcatgactctggcggtggtcctaaggaagcatgagcagaaaattcataaaaatgtatcatcagcaggagatgagactatgaattggcatccagaacaggagatttagagcaaaatctaatttagcattctgagatgagtgtcaggttttcaggagagaatgagttggggtgagcccagagtctgaaactcctgactggtcargtgctacttaagmccagcttgggcaattcagggcagaactcctgtatcagcctcatggacacccagaaaanggtttatggtgaagtgtcagcaggcacagaatctccagaacaacctagagagtgaatgctaatttgtagagcgaatttccatttggcccattatttgtaactgtgtaactgctccaagtgccagaatgcttacacgttaaagcagcacctttccatttgcccacatattcttcttgcacaccccttccattactgctgaataggacattgcatgggaagagtacagaggtggcagaatgaagctagagtgggaaggactaaagactgagccccagagtgctcccagcaaccgccacgtacaaggtctgaaatgacaagggcaagagtgagataggaaactgtgtgtgaaaggaaagcccttgcagtatttctgcctccctttctttctgcctttcaccccactaaatgtaygttattgaatgccagtacttctctagtggatgcacacttgttaaatagtgttaagagatgtggagatgagatatacccctttkgatgtagaattattncatttggtttgtttncatacttcattataggnaatcaagtaatttgatgactaatgtggattatatttcagtcaaagctctgctttcaatttctctgatttgctcactaatgccttrtgtgtgttttactaaccttttatatcttgccttcaagtgagaaggaacaaacaactctcagtggttactacttgcttttatatgctggctgtgaaggttaaaagaaagaatggtctgtaccattttttctgctttgctgcccttttattgtaccccaggcctcctagaggactcctgcagattctattgttgggtgggaaatagtgttggaatgtgtttgcacagtcttatgatattcagtctcagtctgctataggtatttgttattcttggatactacacacctgctcagactgagtaaacatttgtggtgctgtcaacctgatttcttgactctcaaatgatttttgtatttccaatatgaatttgtgtgttatgaatttctgatttctccaatagtatatgccactatataaatttgtattaataaatgacagtcttgttggtttaaaaaaaaaaaaaaaaaaaaaattnctc

SEQ ID NO: 4457 - DNA, 1924 bp, Homo sapiens
  misc_feature (1723)..(1723): n equals a,t,g, or c
  misc_feature (1732)..(1732): n equals a,t,g, or c
  misc_feature (1804)..(1804): n equals a,t,g, or c
  misc_feature (1899)..(1899): n equals a,t,g, or c
  misc_feature (1907)..(1907): n equals a,t,g, or c
ggcacgagcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggytgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaaaaaaaaaaaaaaaaasksgagggkgggcccrrtacccaattcgccctatagtgagtcgtattacaattcactggccgtcgttttacaacgtcgtgactgggaaaaccctggcgttacccaacttaatcgcttgcagcacatccccctttcgccagctggcgtaatagcgaagaggcccgnaccgatcgnccttccaacagttgcgcagcctgaatggcgaatggcaaattgtaagcggtaatattttggtaaaattcgcgntaaatttttggtaaatcaagctcattttttaaccaataggcccaaatcggcaaaatccttataaatcaaaagaatagaccgagatagggttgaangggtggtncaggttggaacaagagt

SEQ ID NO: 4458 - DNA, 2248 bp, Homo sapiens
gggccgcccgcgtaggaaggcacggccggcggcggcggagcgcagcgatggccgggcgagggggcagcgcgctgctggctctgtgcggggcactggctgcctgcgggtggctcctgggcgccgaakcccakgakcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaaaaaaaaaaaaaaaaaaaaaaaaaaaaaaaaaaaaaaaaaaaaaaaaaaaaaaaaaaaaactcgag

SEQ ID NO: 4459 - DNA, 664 bp, Homo sapiens
  misc_feature (562)..(562): n equals a,t,g, or c
  misc_feature (642)..(642): n equals a,t,g, or c
gaatccccttctcgaaatcaaccctcactaaagggaacaaaagctggagctccaccgcggtggcggccgctctagaactagtggatcccccgggctgcaggaattcggcacgagagaaaatgaaagccgacgtccacagggacccaggcagggttgggtgttgtgactcactccacctctgtgccctgcagaggtactgttgggtccttgtcttgtgagcctggggtgagctctctgtacatgttgttgttccacgtatgggttgacttggcatgctggggggtcctcgttcactctctgaagttggcctcctttcactggggattgaaaagcacctccacccctaccctagtgatgtcccctgaggacccgggtgatagtacagtcaatattgtcagtactttgctttgattgaaggctgtagagctgagttaccaaaatttctatttcaaaggaaaccaaaccttaaaaaaaaaaaacaaaaactgggctgggtcttccaaacctaccatgaaaccctggtgtgcaggctgcactcaatgacctcaacccaacacctccntgagtgtgcttcttggaagarcctagaagattcctggatggagaccccattggtcagctcaagtctggccccgtctttcnaaaaaaccaaaacaccattttg

SEQ ID NO: 4460 - DNA, 364 bp, Homo sapiens
  misc_feature (2)..(2): n equals a,t,g, or c
  misc_feature (7)..(7): n equals a,t,g, or c
tncgccncttgcagcccttcgcttctccacaagtcaagtgtgaacagtagcagtggccacaaggagtatctttagacccttcccagcgggtgcctcctgtttggatgccctgagtggcaatggggctggacagatgccccaccacratgggcggcctccccaccagcctgcagaaccaaacagcaaccactgagctccatgctgatgggtcaaaggacaagcaaggcatcttagagcaggcctggrrgctsccacaaagcttacaaatgtgtttgttttttcgaagacgggccagacttgaggctgaaccaatagggtctccatccaggaatcttctaggctcttccaagaagcacacgggtgg

SEQ ID NO: 4461 - DNA, 517 bp, Homo sapiens
  misc_feature (4)..(4): n equals a,t,g, or c
atgncagccccggctttgcctttractgacccactgctcccccagaaataggatccagagcagctattgttayccttagagtgttttccgtctagggccggctcgtgaacagccacatatccttgcacctgacactgtccccacacaaatagctggctttcgttgcttgttgaatgaatgagtgagttggctctatatccccttggagctggccggtaagatattagtgcctcattttacaagaagagaataggaaggaattaagcaatttggccaacagatacaagatagattccagagttttatctcccactttagggtggcarccagtaggccaaactccaaagaccgttgctgatgtctttttctgcctcccctctttgggttagtgtggtatgtacaagctcactcttgttgaaaattagaaaatagttgaaaacaaaaggtttttgtttttctttttaaatcacattaaatgttttacattgcttaaaaaaaaaaaaaaaaaaaactcgag

SEQ ID NO: 4462 - DNA, 754 bp, Homo sapiens
  misc_feature (678)..(678): n equals a,t,g, or c
  misc_feature (699)..(699): n equals a,t,g, or c
  misc_feature (725)..(725): n equals a,t,g, or c
aattcggcacgagaccaattgtacttttattatatcaggctgattcactgtttctaatgcaatgaacttgacacagattttaaatttttyctcaatctgtcccattgtgtagacaaattaattcaaagttctttttcttccttctctttttcatctaagcctgtgcttatgagtagaaaaagagaagaggctaccttgaaatgcctcgggcccaaactcagaaggctctgcactcaactgagcctcccttcctactaagaatggaatagtgttgcttataggggtgttggtccaagtatcagctgtggatgattaattcccagggctgctatcacctaaggtaacttcagtaatcttatgtgtttggaaaggaggatgaggattatttttcaaatacataattttgttttattttgaaacaatctcacacctacagaaaagttgcaattataatacaaagagcttccccctcgcctgaactgtttgatagtaagtttgccaaactgatatacccacgatccccaaatgcttcagtgttatttcctcccagccaaggacattctccctgcataacccacaatacaacccataaaagtcaggaaaatttaacacccagttccatttttgaacccatcctgaaattccaggtgttcattccatgtttttggccagttggtncctttggtatgttccctcccntagcccaaaaaaaaaaaaaaaaaacnccaagggggggggccccggtccccaatcc

SEQ ID NO: 4463 - DNA, 1146 bp, Homo sapiens
  misc_feature (20)..(20): n equals a,t,g, or c
  misc_feature (35)..(37): n equals a,t,g, or c
aaaaaaaacccaggggaacnttgggggccgctttnnnttccccctccaggccattggggaattcttcaagttaatcctgctttgctcttggccaacagggcttgtaggggggagagacccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgyctcatttccggctggggcagmacgtccagcccccagttacgcctgcctcacaccttgsgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgaaaaaraaaaaaaaaaaaaactcga

SEQ ID NO: 4464 - DNA, 914 bp, Homo sapiens
ggcacgagctaaggctaagaaagaacactgtgaaattttcattatatagacattttaaaaatactctgatctttgctgtgctggcttctatagtgtttatggggtggacaactaagacatttagaattgcaaaatgccaatcagattggatggaacgctgggttgacgatgcattttggagcttccttttttcgcttatccttattgtaatcatgtttttgtggagaccatcagcaaacaatcagagatatgccttcatgcccttaatagatgattctgatgatgaaattgaggaattcatggtaacttctgaaaatttaaccgaaggaataaaattaagagcctcaaaatcagtttccaatggaacagctaagcctgccacttctgagaactttgatgaagatttgaagtgggtagaagaaaatattccctcttcattcacagatgtagctcttccagtgttagtggattcagatgaggaaatcatgaccagatctgaaatggctgaaaaaatgttctcttcagaaaagataatgtgattggaacccgtataagaaatgtagttaagcctgaaggactatccttcatcaagactgaaagtgagctttgatttgatattgcctaaaaatttttattgtgttatcttggaagtctgtgtatcaaaatgaagaattcagatggtaggaggttctatagtccttttaaagctgactcttgagtgtcagttgaatatccattaaattggatttggaaataacctgaggaaagtattatgataaagatctgcacagatgcctcttagctgataggtggcaggcctgtgggtttgtgttctccctcttttctctggaacatatgacaattccagattaaagaaaaatgttttttaataaaaaaaaaaaaaaaaaaaaaaa

SEQ ID NO: 4465 - DNA, 2086 bp, Homo sapiens
  misc_feature (2066)..(2067): n equals a,t,g, or c
  misc_feature (2069)..(2069): n equals a,t,g, or c
  misc_feature (2073)..(2073): n equals a,t,g, or c
  misc_feature (2079)..(2079): n equals a,t,g, or c
tcctcacctctttcacaacaggacgtgtattcgcaaacactacttggagggccggtacctccaaggaagtctcctttgcagttgatttatgtgtactgttcccagagccagctcgtacccatgaagagcaacataatttgccggtcataggagcaggaagtgtcgaccttgcagcaggatttggacactctgggagccaaactggatgtggaagctccaaaggtgcagaaaaagggctccaaaatgttgacttttacctctgtcctggaaatcaccctgacgctagctgtagagatacttaccagtttttctgccctgattggacatgtgtaactttagccacctactctgggggatcaactagatcttcaactctttccataagttgtgctcctcatcctaaattatgtactagaaaaaattgtaatcctcttactataactgtccatgaccctaatgcagctcaatggtattatggcatgtcatggggattaagactttatatcccaggatttgatgttgggactatgttcaccatccaaaagaaaatcttggyctcatggagcccccccaagccaatcaggcctttaactgatctaggtgaccctatattccagaaacaccctgacaaagttgatttaactgttcctcagccattcttagttcctagaccccagctacaacaacaacatcttcaacccagcctaatgtctatactaggtggagtacaccatctccttaacctcacccagcctaaactagcccaagattgttggctatgtttaaaagcaaaacccccttattatgtaggattaggagtagaagccacacttaaacgtggccctctatcttgtcatacacgaccccgtgctctcacaataggagatgtgtctggaaatgcttcctgtctgattagtaccgggtataacttatctgcttctccttttcaggctacttgtaatcagtccctgcttacttacataagcacctcagtctcttaccaagcacctaacaatacctggttggcctgcacctcaggtctcactcgctgcattaatggaactgaaccaggacctctcctgtgcgtgttagttcatgtacttccccaggtatatgtgtacagtggaccagaaggacgacaactcatcgctccccctgagttacatcccaggttgcaccaagctgtcccacttctggttcccctattggctggtcttagcatagctggatcagcagccattggtacggctgccctggttcaaggagaaactggactaatatccctgtctcaacaggtggatgctgattttagtaacctccagtctgccatagatatactacattcccaggtagagtctctggctgaagtagttcttcaaaactgccgatgcttagatctgctattcctctctcaaggaggtttatgtgcagctctaggagaaagttgttgcttctatgccaatcaatctggagtcataaaaggtacagtaaaaaaagttcgagaaaatctagataggcaccaacaagaacgagaaaataacatcccctggtatcaaagcatgtttaactggaacccatggctaactactttaatcactgggttagctggacctctcctcatcctactattaagtttaatttttgggccttgtatattaaattcgtttcttaattttataaaacaacgcatagcttctgtcaaacttacgtatcttaagactcaatatgacacccttgttaataactgaggaatcaacaatttgattccccgaaaacatgggtggtgaatgtaatgcccaacattgtttttactaaccctgtttttagactctcccttttgctctcttaatcacctagccttgtttccacatgactaaaactctcgcttagctgagaaagccggacaaactccatctggcccccttgatttgtaagacattaaggactccttacccacccccttcttcaaggagttaacttgtgtaaacagattctcaacatatcaaaagagtccaattaactgataaggtactgaaacaracratgtacgaagtggcggttccagnngnagtncgcccngtgggaa

SEQ ID NO: 4466 - DNA, 647 bp, Homo sapiens
aaaacaggggtggtgaatgtaaggccaaacattggttttaactamccctgttttwagactctcccttttgctctcttaatcacytagcyttgtttcmacatgactaaaactctcgcttagctgagaaagccggacaaactccatctggcccccttgatttgtaagacattaaggactccttacccacccccttcttcaaggagttaacttgtgtaaacagattctcaacatatcaaaagagtccaattaactgataaggtactgaaacaaacaatgtacgaagttcccaggattttgctcaaaagataacaccacaaagcattgagtctgtgtccggcatagcacccatatctaacatcttatgaaggatttagagcccccgcacctgctaccgttgcttttctgtaaacatttgtcttttaaattgtctgtttctctgtaatcatttgtccttttaatttttgcatgtttttacttctgtagaattgttgcgtttgagctcccctccccttcctaaaccaaagtataaaagaaaatcaagccccctcctcatggccgagagaattttgagcgttagcggtctctttggccaccggctaaataaaggactcttaattcatcccaaaaaaaaaaaaaaaaaactcgag

SEQ ID NO: 4467 - DNA, 364 bp, Homo sapiens
  misc_feature (280)..(280): n equals a,t,g, or c
  misc_feature (289)..(289): n equals a,t,g, or c
  misc_feature (322)..(322): n equals a,t,g, or c
ggcagagtcgcacacgggctgccctggagagacatttccatggacatcctcatgctgcttctgcttttgtgtgtaatatatgggagattttcccaagatgaatactccctcaatcaagctatccggaaagaatttacaagaaatgccagaaactgcttgggtggcctgagaaacatcgctgactggtgggactggagtctgaccacacttctggatggcctgtacccgggaggcaccccgtcagcccgtgtgccgggggcttcagcctggagctcttggnggaaaatgnttacctaataggcagtttccgtaattaggcagntaaaagttttttcctagggcatttttgcaagccttccaggcc

SEQ ID NO: 4468 - DNA, 343 bp, Homo sapiens
  misc_feature (67)..(67): n equals a,t,g, or c
  misc_feature (72)..(72): n equals a,t,g, or c
  misc_feature (333)..(333): n equals a,t,g, or c
ccagcgggccatggcttgttmctttgggatccttttaatagtctctgccacactgtgttttggaatnctganaggttttctcatgactttaccccaaaaaagaaaatcttttcaaagtaaatcttttgtgagacttaaagatgtcactgcttatatgtgggaaaaggtcctcacctttctgagactggaaacaccaaagttggaagaggctgagatggttgagaatcacaattactacttggatgaatttgcaaatctgttagacgaacttctgatgaagattaatggtttgtccgacagcctacaactcccccttctggaaaaaacatccancaacacaggg

SEQ ID NO: 4469 - DNA, 576 bp, Homo sapiens
  misc_feature (245)..(245): n equals a,t,g, or c
aaaacatccaacaacacaggggaggcaaggacagaagagagtcccttagtggacatttctagttaccaagctgctgagccagcaagcatcaaggacttctgaggagcctggtaccttgcataggcaywatggaccctgttttgcttaacccacccaacagccaattttagcagacatcctagttttgcaggtgagaagagmtgaggtacggagaagttttgttaatttttccagttcacgtaacnagtaaatgggaaaccaggatgaaaatcaaggtttatctgtcatcagactgttactcataatcaccattcggagagttcagatgtgggacaagattctaactccagccttctcccaaatggttaatttgccagttgccctagagttacatattgtcttatttgtttgttttactgaatctgtctgagtattaaaagccttgtatcttgtgaaatttctttcaggtctcataaaagcgatgaaagagaccaggataacattctaatatttaaataagatttttgaagtaaaatccttattttgtaaatttaaaaaaaaaaaaaaaaaactcga

SEQ ID NO: 4470 - DNA, 981 bp, Homo sapiens
tcggcagcacagagctctggagatgaagaccctgttcctgggtgtcacgctcggcctggcgctgccctgtccttcaccctggrggaggaggatatcacagggacctggtacgtgaaggccatggtggtcgataagactttccggagacaggaggcccagaaggtgtccccagtgaaggtgacagccctgggcggtgggaagttggaagccacgttcaccttcatgagggaggatcggtgcatccagaagaaaatcctgrtgcggaagacggaggagcctggcaaatacagcgcctgtgagcccctcccccaytcccacccccaccytcccccaccgccaaccccagtgcaccagcctccacaggtagagagtgcccaggctgcccttttgccagggccccagctctgcccacctccaaggaggggctggcctctccttcctggggggctggtggccctgacatcagacaccgggtgtgacaggcttgtccgcagtcgagatggaccagatcacgcctgccctctgggaggccctagccattgacacattgaggaagctgaggattgggacaaggaggccaaggattagatgggggcaggaagctcatgtacctgcaggagctgcccaggagggaccaytacatcttttactgcaaagaccagcaccatgggggcstgctccacatgggaaagcttgtgggtaggaattctgataccaaccgggaggccctggaagaatttaagaaattggtgcagcgcaagggactctcggaggaggacattttcacgcccctgcagacgggaagctgcrttcccgaacactaggcagcccccgggtctgcacctccagagcccaccctaccaccagacacagagcccggaccacctggacctaccctccagccatgacccttccctgctcccacccacctgactccaaataaagtccttctcccccaaaaaaaaaaaaaaaaaaactcga

SEQ ID NO: 4471 - DNA, 1589 bp, Homo sapiens
cggcacgagctaagccataatagaaagaatggagaattattgattgaccgtctttattctgtgggctctgattctccaatgggaataccaagggatattatttttacagatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgttggaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagacccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagagaaaaaaaatccagtacttgactcgtggagaggagtcttcgtccgataccaataagtcagcctgatgctctaatggaaaaatggcctcttcaagcctgggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagtaaataatatgattgccttctacagcgctagagattcatatgtttatccccatttttcaggtgaggaaatgcttcagatgaggctccaccttgttaaataaattggatgtatggaaaaatagactgcaaaaaaaaaaaaaaaaaaaaaaaaaaa

SEQ ID NO: 4472 - DNA, 1361 bp, Homo sapiens
  misc_feature (1297)..(1297): n equals a,t,g, or c
acaaaagaccggagctccmccgcggtggcggccgctctagaactagtggatcccccggkctgcaggaattcggcacgagcccgcgccgctgcctggcgctgctgcatctcctgcagctgggttacctgtacaggtgcgtgcaggagctgcggcaggggctgctggtgtggcagcaggaggagccctctgagtttgacttggcctacgccgacttcctcgccctggacatcagcatgctgcggctcttcgagaccttcttggagacggcaccacagctcacgctggtgctggccatcatgctgcagagtggccgggctgagtactaccagtgggttggcatctgcacatccttcctgggcatctcgtgggcactgctcgactaccaccgggccttgcgcacctgcctcccctccaagccgctcctgggcctgggctcctccgtgatctacttcctgtggaacctgctgctgctgtggccccgagtcctggctgtggccctgttctcagccctcttccccagctatgtggccctgcacttcctgggcctgtggctggtactgctgctctgggtctggcttcagggcacagacttcatgccggaccccagctccgagtggctgtaccgggtgacggtggccaccatcctctatttctcctggttcaacgtggctgagggccgcacccgaggccgggccatcatccacttcgccttcctcctgagtgacagcattctcctggtggccacctgggtgactcatagctcctggctgcccagcgggattccactgcagctgtggctgcctgtgggatgcggctgctyctttctgggcctggctctgcggcttgtgtactaccactggctgcaccctagctgctgctggaagcccgaccctgaccaggtaracggggcccggagtctgctttctccaraggggtatcagctgcctcagaacaggcgcatgacccatttagcacagaagtttttccccaaggctaaggatgaggctgcttcgccagtgaagggataggtgaacggcgtcctttgaagcaggatcagacccagccagcagagatggagagtgactctgttggcagaaggcaggcgaggataagctaacgatgctgctgtggcctctatgcactcagcaagagcgggacgcctgtgctgggccgggcaccagggatggtgctgatcsggcarargcctcctttcaaggagttcacagtgaacaagatraraagggctggggccctgrgagggtcaagacccattkttcaagaccttggagaaaraaangactacttttccccccttgccaattgggtataagctgggtgcccccaaaaacttccaacctccc

SEQ ID NO: 4473 - DNA, 783 bp, Homo sapiens
cacccccagtgaacaagatgagaagggccttgggccctggagggtcargagcccyaattatgtacaagacactttgggaggaaaagaagacttaccccccctgtttttttttttccccctgccattggtatagctggtgccccaaaacttccacctccctccctggccacctctaaaatgactggtataggtgctgccccaccccttagctcccctatcctgggctaggaggccacaggggctgtcctctagaattcttccttccctcccccacaccattcattcaattcatgaaacaaatctttgccaagagcagtttatgtgccaggaacatcattctgtccttgcaacctggaacaagaccagctaccagcctagcttcatccsctacttgcaccaaccagtcccgggttagatcycaaatgcyrgaagycagggatgcccaactctgggyrgccccagtcagaacctctgggatctcagtgaagctggcctggcctctgctcytgctctcaaggggctgcttttcaaccaagagccttgtgagcctggtctgagccttgcacagccactgagtattttttwtkccttagccagtgtacctcctacctcagtctatgtgagaggaagagaatgtgtgtscctgtgggtctctrcaagtgacagatgtgttgttttyaacagtattattaggttatgawtaaagcctcatgaaatcctcaaaaaaaaaaaaaaaaaaaaaactcgagggggggcccggtacccaattcgccctatagtgag

SEQ ID NO: 4474 - DNA, 1824 bp, Homo sapiens
ctctgcatctgcctgcctcgggcagaggagggctaccctggggctgagagttcacctgtctcaggaaccacctgagcccacagatcctgtgggcagcggccagggcagccatggcttgggcaagtaggctgggcctgctgctggcactgctgctgcccgtggtcggtgcctccacgccaggcaccgtggtccgactcaacaaggcagcattgagctacgtgtctgaaattgggaaagcccctctccagcgggccctgcaggtcactgtccctcatttcctggactggagtggagaggcgcttcagcccaccaggatccggattctgaatgtccatgtgccccgcctccacctgaaattcattgctggtttcggagtgcgcctgctggcagcagctaattttactttcaaggtctttcgcgccccagagcccctggagctgacgctgcctgtggaactgctggctgacacccgcgtgacccagagctccatcaggacccctgtggtcagcatctctgcctgctctttattctcgggccacgccaacgagtttgatggcagtaacagcacctcccacgcgctgctggtcctggtgcagaagcacattaaagctgtcttgagtaacaagctgtgcctgagcatctccaacctggtgcagggtgtcaatgtccacctgggcaccttaattggcctcaaccccgtgggtcctgagtcccagatccgctattccatggtcagtgtgcccactgtcaccagtgactacatttccctggaagtcaatgctgttctcttcctgctgggcaagcccatcatcctgcccacggatgccaccccttttgtgttgccaaggcatgtgggtaccgagggctccatggccaccgtgggcctctcccagcagctgtttgactctgcgctcctgctgctgcagaaggccggtgccctcaacctggacatcacagggcagctgaggtcggatgacaacctgctgaacacctctgctctgggccggctcatcccggaggtggcccgccagtttcccgagcccatgcctgtggtgctcaaggtgcggctgggtgccacacctgtggccatgctccacacaaacaacgccaccctgcggctgcagcccttcgtggaggtcctggccacagcctccaactcggctttccagtccctcttctccctggatgtggtagtgaacttgagactccagctctctgtgtccaaggtgaagcttcaggggaccacgtctgtgctgggggatgtccagctcacggtggcctcctccaacgtgggcttcattgatacagatcaggtgcgcacactgatgggcaccgtttttgagaagcccctgctggaccatctcaatgctctcttggccatgggaattgccctccctggtgtggtcaacctccactatgtgcccctgagatctttgtctatgagggctacgtggtgatatccagtggactcttctaccagagctgaggcaagaccactgggaggcctgagagtgggccagctcgctgctcaggcgaatttctcatttcaagccactggggaaactgaggcaaaaccatacttagtcatcaccaacaagctggactgcttagctgggctgttttatcttccctgagtgcctgggtctccctccctcacttctgccctttcccttcctcctcctcttctcctccctcttccctcatctcccccctccttcctctgccccaccccaggggggagcagactgctcctccaggctgtatagacctgccctcttgcattaaacaacttctcttgagctgcaaaaaaaaaaaaaaaaaaaa

SEQ ID NO: 4475 - DNA, 1377 bp, Homo sapiens
ggcacgagaaaaccttgaggtgattcatcttccaggctctccttccatcaagtctctcctccctagcgctctgggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggccaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccamtcgccatgtcytcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaaaaaaaaaaaaaaaaaaaaaa

SEQ ID NO: 4476 - DNA, 2663 bp, Homo sapiens
cccccgggctgcaggtttggattggaaagaggagctgggcaggaggcagggcaaggagaaagctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttggtatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatcccctaggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaaaaaaaaaaaaaaaaaaa

SEQ ID NO: 4477 - DNA, 1937 bp, Homo sapiens
  misc_feature (1884)..(1884): n equals a,t,g, or c
  misc_feature (1893)..(1893): n equals a,t,g, or c
aagaggagctgggcaggaggcagggcaaggagaaagctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgaggggcttttgtatkgttctactttttcagcccttttactttnctgggctgnaggcttcccctgggagtggcctgtattaagttggggctatttag

SEQ ID NO: 4478 - DNA, 1206 bp, Homo sapiens
  misc_feature (9)..(9): n equals a,t,g, or c
  misc_feature (32)..(32): n equals a,t,g, or c
aaagcttanaaaaagactttctttgaaattcnctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaaaaaaaaaaaaaaaagggcggccgctctagaggatccaagcttacgtacgcgtgcatgcgacgtcatagctcttctatagtgtcaccta

SEQ ID NO: 4479 - DNA, 908 bp, Homo sapiens
  misc_feature (875)..(875): n equals a,t,g, or c
  misc_feature (893)..(893): n equals a,t,g, or c
ggacccgctgtcgggctaggccatggctgaggggtgcacggcggccayctgagtgcggrcggtgtcagagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacaccgtgtgtggcttctaacatctacggcaccgtgaacaacacggtgaccttgcgcgtcatcttcacttctggrgacatggggtgtctactacatggtccgtgtgctggkggccttcacatcgcatggtcctcaatatcacccgcctgtgcatgatgagcaccctcttaagnagactgagaaggccatcnatgagtcttaggacc

SEQ ID NO: 4480 - DNA, 889 bp, Homo sapiens
  misc_feature (15)..(15): n equals a,t,g, or c
  misc_feature (19)..(19): n equals a,t,g, or c
  misc_feature (22)..(22): n equals a,t,g, or c
  misc_feature (40)..(40): n equals a,t,g, or c
  misc_feature (90)..(90): n equals a,t,g, or c
  misc_feature (118)..(118): n equals a,t,g, or c
  misc_feature (776)..(776): n equals a,t,g, or c
ctggagttcaaagancccnttntccaagtgcccccctggnattggctttccctttttaaaaagtataggtctgctacaatagcaaatgcncgtacgtgggttttttgcagtttcttcncagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccattgctccagaaggccacagagtggtanaaaatyacaggtaaaggctcagacagcccctgtgatattggtggtcttatccttacattcttctcccttggctaagacaggacttaatatgaaaagtccagcacccaggccac

SEQ ID NO: 4481 - DNA, 414 bp, Homo sapiens
  misc_feature (394)..(394): n equals a,t,g, or c
gtttgggttatagcaagagttctgagatacaaatgtgttcattttatcttccagtgactacattcacatcaatggcttaggacatgtatttacaaattcctgtgaaacacatgttacactcaggttatcaggctacctttttttcccccaagataggatgttcaagcattctagtttttgtttgtttgcttgtwtttttgagacagagtctggctctgttgcccaggctggagtacagtggtgctatcttggctcactgcaatctccacctcctgggttccagcgattctcctgcctcagcctccccagtagctgggattacaggcatgcaccaccacacccagctawttttttgtacttttagyagagawgggatttaccagttggccagctngtctccaaatcctgacctca

SEQ ID NO: 4482 - DNA, 636 bp, Homo sapiens
  misc_feature (21)..(21): n equals a,t,g, or c
  misc_feature (35)..(35): n equals a,t,g, or c
  misc_feature (43)..(43): n equals a,t,g, or c
  misc_feature (65)..(65): n equals a,t,g, or c
  misc_feature (106)..(106): n equals a,t,g, or c
  misc_feature (127)..(127): n equals a,t,g, or c
ctcaagaactaatcaaccatnatataatgtatgcngcttttgnttgagaacatcataaattaatnggatctggaatataaaataccagaaattgttatatgttgcntggtttgtcttttagtgggantgaaaagtacagctgggagcagtggctcatgcttgtaatcccagcacttcaggaggccgaggcaggaggatcacttgaggtcrggagttcaagactagcctggccaacaaggtgaaaccctgtctctactaaaaatacaaaattagccagatgtggtggtgtatgcctgtagtcccagctacccgggaggctgaggcacgagaatggcttatacccgggaggtggaagttgcattgagccgagatcatgctactgcactcagcmwgggtaacagactgagactccatctcaaaaggagaaaagtacagctcctaatttaatactcctaaaatattttttggcacctaccacagacaaggtactttgataagtactggggacaccatatcctgtctaggtctgttatgttcatctgcagctagagaggggattgcaatatgcaggattctgaagaaacacaagcataaaggggccaaattatacatttaggtctcacatgtagatctcga

SEQ ID NO: 4483 - DNA, 1186 bp, Homo sapiens; identical to SEQ ID NO: 1627

SEQ ID NO: 4484 - DNA, 1296 bp, Homo sapiens
ggcacgagggcacacccagagaggttcttcaaaaatttcaattacatcatgtctctccttcgttaaaaaatatttaatgattttctacccatgaaataattctgctagactgcaagctctaaagatgcaaggactaggtttgccttatttgtttctgtttatgcagagcctagccttgcatgtagtaggaacttaacacattgacctagatcttgtccaccttctcagcctcacctctcatggaagcactcatagacctcagtccagttacwcttttctcagatccctgagatggcctggtccagggctgcctggaccgtgatgcgttcactcctgatttgttggctggtatctgcttatattcttgctactgtaactgatgtccaaggaagtcacataggcatccctgggagcttgctagagctcaggcaccaccctagatccaatgaatcagaatctgcatgttgacaaggtccccaggtggttcatatgtacattcaagtttacggtgctttgctctggatcccagcctragtgttagtyctttaaagagacctttcccaactggscaaatcttatcaagtcatgtgatggattcacccacacggtctgtgatacagaagggaaaagaagttgagacctattgatcagaagctgctcactttagagttttacctamgggtgatcctatcaaaagttctggattttgtagagaagcatacaaagtatgtgaatagtttgatttgagcacattgaaaattgccagttttctttgctttaaccaatgtttgctttccctctggaaatcccttgttacaggtccttagttttagtttgccacattatgacacgatgggaataatgcacagcagtgatcctcagttggtttgggttttcaatacataattgatccatggttgtggcatgcattgtagcatgtccaactagaatacctattctttcaattactttcattactttcaatggcaaaaccacaattacttttgcactaacctgatagctttgctacaagtcagttgktcagttttctttttttgktgctgkttgkttttatttttgcaaacactttagatactgcatartggatggatwagtttgkggttcctgggatcttctgkgkattctgktgaagctcaataatcacattactgsggacctccaaaattttacaaaggactgcacagtgagtattcagtcgataaactaaaccacagcttaatactgtgagatgaaagaaagcacaccaattaaaagtaaacactgtttaaacctaaa

SEQ ID NO: 4485 - DNA, 593 bp, Homo sapiens
  misc_feature (8)..(8): n equals a,t,g, or c
  misc_feature (26)..(26): n equals a,t,g, or c
  misc_feature (30)..(31): n equals a,t,g, or c
  misc_feature (35)..(35): n equals a,t,g, or c
ctggaaancttgtagttattcaacanacannctanaagtgttggcagagatgtaattttaaagcacaatcccactcattcgttcagtattacagctgctccttgtttgtttaataatagaactgatgagtagttratttgaraggaaagctggtgcaggtgtartgctatttggatgtcatggaggacacatgtgacatctgcagctagctatatggtaaaagcaaaacagaagttaaaatcagccctgtgtcaaatctgcatagttttaggcttcagggagtgtctctgtatgttgaggcaggaagtttagtagaattccaaggaagtaagagaggaacaaacatttgtagattttgccttctatgggggaactcattcaatcatcaggagaactcttcaataggttttatttgctccggtttacctagatgaaaaattgagacccagaatccatgcttttctttcctggttacacattagaatcaccaatgtgacattaaaacacacacacacacacacacacacacacacacacacacactgcacacccattaggatggctgctatcaaaaaaaaaaaaaaaaaactcga

SEQ ID NO: 4486 - DNA, 1378 bp, Homo sapiens
ggttttttttttttttttttgctttaagtttcaggatacatgtgcagaatgtgcaggtttgttacataggtatacgggtgccatggtggtttgttacacagatatacctgtgccatggtggtttgctacacctattgacccatcctctaagttccttcccctcactcgccacccgctaacaagccctggtgtgtgttgttccctccctgtgcccatgtgttctcattgttcagctcccacttatgagtgagaacatgtggtgtttggttttctgttcctgtgttagtttgccgaggatgatggcttccagcttcatccatgacatagcaaaagacatgatctcattcctttttatgagtgcatggtattacacgtattttaatagctttgaaatttatcgatttcaattyacatttattgagtactcactatgggtcaaacaccatgcttctttaccaggggtacaataaacagagccaaaattttatttaacttgtatatacaactttactatcaacattagccattgaggtgtaaaaataaagaagcaatttgtattaaaagtcaatttccacataatcacgtcttataaatgccatttacttttattatacataactcaggaaggtgagttttagtaaacactgaaaagctatttactgaaatttattaattgctttagaatgaaaacaaaacaaaatgcttgtaagcaattacagagaaaagagaggtacacatggtaaaatatttaaaataaagttcatacaattaaaaatattatcataccactgacctttggtttaaaaaaacaactatgattcaaggataaaatatgttaaatcsataawataatacaacatamtttctagagaatttggctttttctactactctaaatgtgtcacatcctawtagcatcacaaaatttaattatgatactarkaattatkstaattattattaaagcattataattctattattagaattacttggcactcattcaaagagatataaacatatcaattaaaaaccatgtatttttcaaaaaataaaactgaactaattataaaaaataaagattcctgtaacggattttaatcttaataccctggagaaccttaatgttaatcacattcagaatttgttttttcagctctcccttctgactggagctgaggctaagataggaaaaaaaagtccacttcccagtcatgccctggtttctgctgcttttgtcttcacactgtatctttagttttatgcagcagyccaaggcttgtaattcttctgatgacacatccatgccattgcggctgtctccgaactccaccaaagagcatggagactctgtaagactgtttcggagcttgtcaac

SEQ ID NO: 4487 - DNA, 789 bp, Homo sapiens
tggacctcaagtgatcagtctgccttggtctcccagagtgctgagattacaggtgtgagccaccgcgcctggcctagagtacgatgtatcttgtaacaaaacacaatataaaacaaaatgctagtggatttttctttttgttctttaaaaatgattgttttctaatcattctcctatatggtggttgggagtaaaaacctcaccttagaagaagagcacaattatcaaattgttaactgttttttttgtttttgtttttgtttttttgagacagagtgtcctgctttgttgcccagcctggagggcagtggcgtgatcttggctcactgcaatctccacctcccaggttcaagcagttctcctgctgcctcagcctccccattagctagaattataggtatgtgtcaccacgcccggctgatttttgtatttttagtggtgacagggcttcaccatgttggccaggctagcctcgaactcctgacctcaggtgatccgcctgcctgtgcctcccgaagtgcttggattataggcatgagccactgcggccagtcaaattcttaacttttaacttaaaaagttattttcccagtctacawcagaaagtgaattggagatgcaatggggaagaaccaatgggtttggtctcttcttgactttttagctggagagtaggctggagactgttagaaatgagcaaagagactttctccgaggttggtttggatcctgagctgtacattgcttcctttgctttcctattgcttctgcaaagggaagcatactaga

SEQ ID NO: 4488 - DNA, 2181 bp, Homo sapiens
  misc_feature (63)..(63): n equals a,t,g, or c
  misc_feature (2052)..(2052): n equals a,t,g, or c
  misc_feature (2063)..(2063): n equals a,t,g, or c
  misc_feature (2080)..(2080): n equals a,t,g, or c
  misc_feature (2107)..(2107): n equals a,t,g, or c
  misc_feature (2120)..(2120): n equals a,t,g, or c
  misc_feature (2157)..(2157): n equals a,t,g, or c
taacaaaagctgcagctccaccgcggtggcggccgctctagaactagtggatcccccgggctncaggaattcggcacgagagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggsccctctgctyamtgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagacgtgaggctgctgaacaagggcacggaacattactcgtatccctgcacacccacgaccatgctgcsgcgcagtgcctactggcaccacatcactggttcccagaacatcgccgaagcctccagctatgctggtgagtcgcttccatgccccacacccacctgccaggaggctttgtggaggatgaggcctgttgggcaggggtcttttgacctagctctgagttctgagcctgcttctgtgcccacaggtgacgggtatggggcaagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggwtgaggstggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggnttttaaaagtnaacttctgcamagsgtnccttcckgctttgtwaggcyggggaanawgcccyggggtnarggggtgcygattatcccagtggaagaaagccggangctgtttcctgccccaggaataag

SEQ ID NO: 4489 - DNA, 1466 bp, Homo sapiens
ggcagagccagcaggtggcttctcagttcctctgggcctggagtgacacaggaaggatctgcacttcctctgtgctgcttgccagcttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggtttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctaagggccagccctggggcaagaactggaagggtttataggccccctgaataaaggctatggcacttgatcctcaacaccagwcatctaaggkacactgaaaatgactcattttggacagaaagggttagagtaaagagctggactaacaggagagaagtcyagttggktccc

SEQ ID NO: 4490 - DNA, 786 bp, Homo sapiens
cccacccggggagggtcgttgtgcgcctgcccagggtgggggttgccgtcgcgcctaggcctttccctcaggttttcctcttccccactgcggctccccagtcggcgcttgcgggagaactcagcgctgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccaaaaaaaaaaaaaaaaaactcga

SEQ ID NO: 4491 - DNA, 362 bp, Homo sapiens; identical to SEQ ID NO: 1639
  misc_feature (343)..(343): n equals a,t,g, or c
  misc_feature (345)..(345): n equals a,t,g, or c

SEQ ID NO: 4492 - DNA, 544 bp, Homo sapiens
ggcacgagcagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagttagcacccaggggttgattcaggaagttcttcctttttctagcctgcatccttcctggccamcccctttatttytcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctggggagccttcaggcaaaacctggcagttctcaggaacccagactg

SEQ ID NO: 4493 - DNA, 399 bp, Homo sapiens
ggcacgaggttactcccacrgctctgggcagccaggccctcccctcctgcctcctggtcttctctactccgctggttctgacccatcccctggctctgcccgccgtcccccaccctgcccctgctgagtatcttcttcctccccacgcacccccctcccccatctaggcgaggtgggctcgggcgtcccaggccctccttagaaaagccgtctctctcgagtgcagtggtcccacctcccaaccccatcactgctgcccaccccatattaactgtaattttgtaagaagagtgacttgttggtttaataaatctctagttattgtaataatttattggctgccataatgtatttattagtcgcctaccgttaataaaaagtgcccgcttaaaaaaaaaa

SEQ ID NO: 4494 - DNA, 1433 bp, Homo sapiens; identical to SEQ ID NO: 1642

SEQ ID NO: 4495 - DNA, 602 bp, Homo sapiens; identical to SEQ ID NO: 1645

SEQ ID NO: 4496 - DNA, 617 bp, Homo sapiens
ggcacagcacagcctgagatcttggggatccctcagcctaacacccacagacgtcagctggtggattcccgctgcatcaaggcctacccactgtctccatgctgggctctccctgccttctgtggctcctggccgtgaccttcttggttcccagagctcagcccttggcccctcaagactttgaagaagaggaggcagatgagactgagacggcgtggccgcctttgccggctgtcccctgcgactacgaccactgccgacacctgcaggtgccctgcaaggagctacagagggtcgggccggcggcctgcctgtgcccaggaytctccagccccgcccagccgcccgacccgccgcgcatgggagaagtgcgcattgcggccgaagagggccgcgcagtggtccactggtgtgcccccttctccccggtcctccactactggctgctgctttgggacggcagcgagstgcgcagaaggggcccgccgctgaacgctacggtccgcagagccgaactgaaggggctgaagccagggggcatttatgtcgtttgcgtagtggccgctaacgaggccggggcaagccgcgtgccccaggctggaggagagggcctcgag

SEQ ID NO: 4497 - DNA, 1246 bp, Homo sapiens
aggtgggcgcaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcagccgtgggtcctgctctgtgaaaaaaaaa

SEQ ID NO: 4498 - DNA, 1193 bp, Homo sapiens
  misc_feature (512)..(512): n equals a,t,g, or c
  misc_feature (1167)..(1167): n equals a,t,g, or c
  misc_feature (1169)..(1169): n equals a,t,g, or c
  misc_feature (1171)..(1171): n equals a,t,g, or c
  misc_feature (1185)..(1185): n equals a,t,g, or c
ggccgggcggtgcgcactgcgggcgcatccctgccccggcgccgtccgtgcccgcgggacctgacagccgggtcagagggcgaactgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggcctgggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagcctgatgcgggagctggatgaggagggctctgatccccccctgccggggagggcccagcgcatccgacagntgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacgctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcaaaaaaaaaaaaaaaaancncnagggggggcccggnacccaatt

SEQ ID NO: 4499 - DNA, 463 bp, Homo sapiens
  misc_feature (458)..(459): n equals a,t,g, or c
catgcgggggacgcagctggtgctcctggcgctggtgctggctgcctgcggagagctggcgccggccctgcgctgctacgtctgtccggagcccacaggagtgtcggactgtgtcaccatcgccacctgcaccaccaacgaaaccatgtgcaagaccacactctactcccgggagatagtgtaccccttccagggggactccacggtgaccaagtcctgtgccagcaagtgtaagccctcggatgtggatggcatcggccagaccctgcccgtgtcctgctgcaatactgagctgtgcaatgtagacggggcgcccgctctgaacagcctccactgcggggccctcacgctcctcccactcttgagcctccgactgtagagtccccgcccacccccatggccctatgcggcccagccccgaatgccttgaagaagtgccccctgcaaaaaaaaaaaannaaaa

SEQ ID NO: 4500 - DNA, 756 bp, Homo sapiens
  misc_feature (651)..(651): n equals a,t,g, or c
  misc_feature (660)..(660): n equals a,t,g, or c
  misc_feature (696)..(696): n equals a,t,g, or c
  misc_feature (710)..(711): n equals a,t,g, or c
cagtgctcaaggcgctgcgcagaccctgaaaagcggccaggtgacccctagctttccttttccggttgcggcgccgcgcggtgaggttgtctagtccacgctcggagccatgccgtccaagggyccgctgcagtckgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaaaaaaaaaaaaaaaaaaaaaactygrgggggggcccggnacccaattngccctatagtgagtcgtattacaattcactggccgncggtttacaacgtnntgactgggaaaaccctggcgttacccaacttaaatcgcctttgca

SEQ ID NO: 4501 - DNA, 802 bp, Homo sapiens
  misc_feature (39)..(39): n equals a,t,g, or c
  misc_feature (78)..(78): n equals a,t,g, or c
  misc_feature (786)..(786): n equals a,t,g, or c
  misc_feature (788)..(788): n equals a,t,g, or c
  misc_feature (790)..(790): n equals a,t,g, or c
  misc_feature (793)..(793): n equals a,t,g, or c
gcctccccttttagggaaagctgggtacgcctgcaggtnccgggtccggaatttcccggggtcggacccaggcgtccngcgaagctcgaccgctacccgcaccctaaatcccagaggttggccccctgaggtgcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtcaaaaaaaaaaaaaaaaaaaaaaaaaaaaaaaaaaaaaaaaaaaaaaaaaaaaaaanananaanactgaggaa

SEQ ID NO: 4502 - DNA, 906 bp, Homo sapiens
  misc_feature (144)..(145): n equals a,t,g, or c
actccctcacccaggtcccagccctgggaaccacctaccgtgagcccttttgcagatatagactcatttcatcctcagatggtccttcaaggtaggtactttagtcccattttagagatgagacgattgaggccagaggggtgnngtaacttgcctgggggctcacgagcacaaaaggagccgaggcaggatctgacccttgttctctggcctcactgccctcactttgccatgacccgaagttatgtccctacaaagcaatgcatggtccaaggytctttttattgtatttttatttttaagggtcctgttcaaaactggtgtgagctctgaggagtcctgaaccctgggtgcagcatcctagcatcctgggagtccttttctgcccacactgagctgggctcctcgaggggtggggctgctgtccctggaagcctggcagcagcactgtatcgggttggctgaagctgarcgccgtggggtgcagggctccmggaatccccgtttggctgaaggggttccctgtagccmgggatgtttatgaggtctctctgatgccccaggcgcaggacatgtgtgcgggtggagaaaagcaggccctttcagtgccagctccactcaatttctatgtggaccaagaacgataaacttaaaaaattttttttcctaaggtatcttcagaatatggtgtatttttatgtggaaaagaaaagttatgaaggcagctgttactttaagagaaaattcattaaaagtcctcgaggtatgaagatgacggcgtgcttctcaatcattttggcataacttgattgtggctgtaatttttttttttttttttgtcaagcatgtcagacaataaagtctttgtaaaaagrgaaaaaaaaaaaaaaaaaaaaaaaaactcga

SEQ ID NO: 4503 - DNA, 1105 bp, Homo sapiens
gaattcggcagagcccacttagaggagctaaaatagctaaaggttacatgctttgcctcaaataatagacttagtgaagagggtagaagtagaaatraggtcagccccccagagcagtctggtggccttragcaaccaggaaggtaaagccggtacctcagttaaatcaccaagtttactggaagtgcatatttttcatgtgccaaattcagtaagtcatggagcaaatgtttattttgctatgctttaaaaagttgcttgcttcttgtaagttttctcagtggaagggttccaagttatgacttaatctatgtttgcagcattgcactggaaacaggatttgtctgtgaaatggctctgtcatttgtggaccacttctgtagggagattgtggatttaggaagggcagaagcaacagcagatatgcctggtgtttgaatggatgtgcctctytcggaggcagcaagcagcatacccatattataaagtttttgattttctaacatctgaagacaggcatccagccttgcagaacagccaggtgtctgttctatagactacagttccttgtttccagaattacggtaaccaaataatacacaaggtcacctgattgcacttcccaacaacctgaacaaagagcacctttgcgcttgctggtaggtgctgtaccagactctttgtaatctgccttagktcagrgaagaacaagccattaccagtatgggagtccatccytagtcagggctagttgctattatcccttgaatactctgcaggcatcccacaagacatttgagacttcatatttgtcaaataatagaaatstggctggcctagtggctcatgcctgtaatcctaaccctttgggaggctgatgtgggcagattgcttgaggccaggagtttgagacccacctgggcaacacagtgacatgttgtctctacaaaaaatttaaaaattaactaggcatggtagtgtgcctatagtcccagctactccagaggctgaggcaggaagatcccttgagcccagtaattcaaggctacagttagctctgatcctgccactgcactcctgtcttggtaaaggagctaaacccagt

SEQ ID NO: 4504 - DNA, 1766 bp, Homo sapiens
gtkattcaaagccatcacaaaacactataagactgaccaaaatttagataacctttgaaccacgatttttttccacatctgtctgtgagacacagcgcaatgctactgcccttccagaaactgtgctaaaaagagaaagtccaaaagactctaaacaaaaacctcgacgccgttgaggatgtgtttcattctggtggtctgttttgcaagcttgataacagaatgtccgtgccattgtaaatgttgtagagatgtgggccgtggcccaaccgtcctatatgagatgtagcatggtacagaacaaactgcttacacaggtctcactagttagaaacctgtgggccatggaggtcagacatccatcttgtccatctataggcaagaagtgtttccagatcctttggaaaggtgggcatggggcaggtgcttggagagtggcgtttgagccagagcgaccccatttcccgtgtgaaccataggcacaacccaggaagtttccccacttgtaggagtgtgggtattccagagcaagactgtggccaccatcttcccctcttggtgttttccgaaagtgacagtgttggtcatcccatgaccactgaagcttagtaaccagcgccaaaaagtagattcatcaaactagagaccccagctccccttctcgccatcttctttctcaagttgaccgtggtgctgtttctggaaggcatctgcaactccaagtccatgcagaactctggaaggccaagttcatcgcagcatgttcaccatatcccagcctccaaatctatcctcctaccttccaacgcatgacctgttggggagcagagacttaacccccaactcagaggaacccttcctccagcgtctttggcatggtttctagggtgagagttcccaatttggatagaacggccaccatattggttactgaatctctctcccttgtttttattacgtttcctttttcaaactgtccatgggaaggctgaattgagtgactccccagaatgaagatgagaaggtgaatataatcaatgccaatgtaatgccagcggggtgagatgcccgatggagrtttcaaagatgtagctagcattttgaaaccatatgggcaaaacccggcaaccagaaggggacagataaggaccgttccagaaatcccaactctcacacccagcccaggctgcagtctccacaccaaacagtcaacaaaacacaaaccctgaaggaaaaccttttccatacacccaggctatgcattgaagagttttccactgtatacatttttatccagatgaaggtatttttatattttgacaataggaaacagtgaccattttcagagtaatcaaatctggaacaaatgaaacatcttttagccaccaccaccctgttgcaattaagacaaccgtgggggaacacaccactttttactgttgaaaccaacacaacgttgaaatccaggcttatacgcagactccgattccctagagaactaaatttggctttagtgtgacgggatttgattaagcacttagtatagtcttttgaacacggaaatcctgttgtacttaaagctagcggacccgtgaacaactttgtcaggttcacgtcctataacggttmaaaracacacacacacatacacaaaccgtttctatgagagattgatgaactttgtttaaaattttaaaaaaaggaacacgttctgtaaacgagtcgctaaatacagaattgtataataaaaaaaaaaaaaaaaaawt

SEQ ID NO: 4505 - DNA, 5367 bp, Homo sapiens
ccacgcgtccggctctctcgccaaccgtggtggctccttgcgttcctacatcctctcatctgagaatcagagagcataatcttcttacgggcccgtgatttattaacgtggcttaatctgaaggttctcagtcaaattctttgtgatctactgattgtgggggcatggcaaggtttgcttaaaggagcttggctggtttgggcccttgtagctgacagaaggtggccagggagaaggcagcacactgctcggagaatgaaggcgcttctgttgctggtcttgccttggctcagtcctgctaactacattgacaatgtgggcaacctgcacttcctgtattcagaactctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagttatagttgtcttttagtatgtgatactaattaagattacttttgtattatcactatttaaaagatcctagtaatatattctttcaaataccatgttatttgttaccatcaccgatgaatacctcctaggcttatccctaaaaatgctcgctcagagaattaattataaacttgttttgtttttagtaagaaatggctaaagctctttttttcccacaatcgttagtaactgtataaaaactctatgctgctccaccagtgggccttggaaaatgcatcaagaaggccaaaccagcttgaccctggctcacagacatggtcatgaggcgatttaaatttgtgccacaatgaagagtgtgtgtacacatgcctcctagaaactacactatgggtaattaatttatttcatagaggccacccagatgccttataggttttattaatttggatatgaaagtgtaccccatttggtttcaccaggaacccaaatttagaatattgaaaagccatcaaaaagttgtgatatcaaaaatgtatgagtctcttaatatactaagcaagagtgtcacagcagtaatgataaagactagttttaatctcaagccttagaggggccctttgttgccttttgtggtgcagcctcttaagagagtggtgtttgattaacaaaaaaactgtggcccaagtggaacccttgaccttttctcagataatctgtgtatgtacacagctaacacagctctttagattccctgttaagtgactcattcacattccttttttggatataaagtcattgctgtctttttatttttgaaatagtacaagacaaagatttttaacttaacatgaaaaattcactcttttattttggaaaaaaagttaacttttcatactaacaaacagaacaagatttaaggtaaatttcttaagcattatccagaaaaataacaagatttatagtatctacttctggtactaatatacacaaaaggccaaaaccatgcctattctgcaggtgtagcttcggtgctctcctgttcaggggcaggctcactgcccgcttcttttccttctttgcttcttttagattttttgtgtttgtgtctcctgtgactatctccttcttcactttcatggcgacgtctactattacttcgagaagacttatgtctggtttcctctttctccctgtgtcgtctttctctatgtcgttcttctttttctcgacttgctctgtgacgctcataacctctttctgcatattccctgtatctgtatcgttcttcatcgctgttgaaaacacttggtgtaggactgtgatcacgctccctctctctctctctggtgcgttctctttctctgtcccgatcacggtctcgctctctgtctctgtctctctctctatctcggtctttctctcttctggcataatagtcccactgcttgctggtgtccacaagactaggccacgaaggagcagaaccaggaagatggggaaaggcaacattgccatatggaaatgcacgtgcagaacgactatcataaccagaggaatgtccactttctattgttggtataagagatggaggtggagcgcctggtggaggaggaaaacccggtggtggaatcagaggtggagcagtgctgacagtcggaggaggtggaagaaatggaggaggtggaaggtgagtgggaggagctcctggagggaaaaacggaggtggtttgctaaaattgttgtctacttcagtagcagatctttcagaaaggacctgtatgttgctgttctcatttgcccgtcgcctgccttctactcggctgatagttatagtctgaccgataacatcaattgccccaggtaatctcctgctcggtggaagcccagtcttgaacaaagaaggaggagaagtaaactcagcttttgtagatggaagggcagtttctttctctgagtttccagttcttccctgctgtaccgtaattttatttgtagtagaggttactggtataacttcaagtcccattcgtatcctcttttgtttttcacagtaagctttccaggtatcttcattaaacccataattaaaataatcagaaagatcagcaccaggtttacgccatggtttatcttcaaaagaatccaaatctacctctaagagtggaactccattaatgcttccaggtgcatcaaggtctactcctttgacttttgtccctgtagttccataaactcttccccctgtcttgatgttaagatttacaggtgctgtaccataactcccatactgtggtgctcccgttttaatgtctcctatagtgacatgaacatcatcttcatcatcatcgctgtcactatcactatcatcttcggtctcagtcactttcggttttggtaaaccattttcagcagtttcatcttcaattccagatggaggattagcactggcattttcttcttctggcctttcaacttcattttcatcgccatagagccactcttcctcctcatcccctccggtcccgccgctcagctccgacactaggcgctcgacctcgccggccgacatggccgccccgagcgcaacttaaacgcggcgatcaacagccccctccaaccccttccccagcctcgcagccccgaggcgcgagaagggcgcgaacccgccgacgaacgaacgaagaaagctcgagactccaatcccaggaaggcgacggcagcggcggcaaagatgaagcctccagcgcaggcggacgcgtgggc

SEQ ID NO: 4506 - DNA, 2249 bp, Homo sapiens
tcgacccacgcgtccgtgctcggagaatgaaggcgcttctgttgctggtcttgccttggctcagtcctgctaactacattgacaatgtgggcaacctgcacttcctgtattcagaactctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtaggccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccgcgctggaacagcaatggcagctggtccccagggccaggggagaggagcaacactcccaagcccctccatcctacaattacttgtcatgagaaggtggtaaatatccaaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtccgaactgacagaggtcagcccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataataggctaagaagttgaaacactatatttatcttgtcagtttttatatttaaagaaagaatacattgtaaaaatgtcaggaaaagtatgatcgtctaatgaaagccagttacacctcagaaaatatgattccaaaaaaattaaaactactagttttttttcagtgtggaggatttctcattactctacaacattgtttatattttttctattcaataaaaagccctaaaacaacaaaaaaaaaaaaaaaaaaaaaaaaaaaaaaaaaaaaaaaaaaaa

SEQ ID NO: 4507 - DNA, 955 bp, Homo sapiens; identical to SEQ ID NO: 1667

SEQ ID NO: 4508 - DNA, 1680 bp, Homo sapiens
aattcccgggtcgacccacgcgtccgcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttcccggacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaaaaaaaaaaaaaaaaaaaaaaaaaaaaaaaaaaaaaaaaaaaaaaaaa

SEQ ID NO: 4509 - DNA, 593 bp, Homo sapiens
  misc_feature (504)..(504): n equals a,t,g, or c
  misc_feature (578)..(578): n equals a,t,g, or c
  misc_feature (584)..(584): n equals a,t,g, or c
  misc_feature (589)..(589): n equals a,t,g, or c
ggcggacgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcggcacacggagctgctgacggtggagcargccctggccgacttcgcagagctgctccgcgcgctacgacgcgacctcgggcccargatgcccccgscatcrccttcggtgggaagntatgggggggaatgcttaagtggctaaccttgaggaatgaaagtaattcccaacctgggtggggcggggggccncttggncgggnccaa

SEQ ID NO: 4510 - DNA, 2042 bp, Homo sapiens
  misc_feature (1)..(1): n equals a,t,g, or c
  misc_feature (42)..(42): n equals a,t,g, or c
  misc_feature (2026)..(2026): n equals a,t,g, or c
nggtcccctgcaggtaccggtccggaattcccgggtcgaccnacgcgtccgctggagctctggtgtatcgaattgtgttatgagataagccactagcagggacttgaacattccattttctttagattttgttgtatcagcatgtgaatatgctgaatacaacttgtatcctaaagcatacaagctataacattttcacgttggactcaaatttcttcatcatctgtattgtatgaattttgtatactgttttgttggtggatttctaacataagattgccagttcctgctagctttttaaaaagatcctcaggttgctgtagctggatgatcacatgtcatttaatttccgatccttaaaatggagtgcgggctacctaagtttgcaggctgtctttttatgatcctgtgtttatggaattgccctgaagccatggaatgtgaggatgggtttcattgtagcagtgtgggtttgttggtttttgccagtatattttataacaagaaayaggagmcttgttggataattcaaggctatattttggccagttgataaagattatatatttgtgagtaacatcttttaagttggtatatcctaaagttgaaatactctgctgygtgttactttctcattatgtttgggctcttttcttcactgtcaatatttggattacctgaagatgatatcccaattctctgtaaacacattttagatgtttctttaagagataagaattaggtcaaactttttaacatctaaataacaatgactttgattctcaagagttaggggaggataaattgctataagcttggacaaaattctaattggatttgaaaagcagaagaaacttactattgcttggattatggagccctgtttgggagtctaacacagaacagagaaggacagaattgtgaaacactttgctatgaattcattgattcagtagttatagtaatacttcctagaagccactgaagaagatacaaagtggggagtacaaaggttggatggaaaagaaataagcacagtgctatagaactagacagtgtcgtaagacctgtcacaagtcaatattctatgaaatgacagattctgataagtgtttctcagtttcagtgggtgtaaatcttttgtttgtgggggttggtttcctttaggagaagttaattgaactgatcctcaaaggatgaaatttaaacacctcaaagtcagcatttctccgtgttgtccagtgcctagtgaagatgaagacttttcttgccattgcttgactccaagtaaagctgtgaatgtagttgagcgattctccagacctgccagctgcagtttccctcctaccggaagacagaaagactttcagtcctcaagctgaaatgagagagccatcctaccttgaataaatgggcccattgttaattttaagctcttgagtattttcttttatattccctccaagctaccctgtcattatgccaagttagaaaattaatttagtttgtataactatatgatgtatatttcacatgtgtgttcactctgctttaaaaatattaattaccttttgtgtgaagttcagagacctgtcttttcccatgtggcagttttatatgttttgtggtcacaaatgtcaggaatctcaatgtaattctggataaatttttctgctctatgatttgtaaagaaatgaaaatcttatattttttaattgaaaattagtagttttagaaaaaaacgcacttatttgattttagtaaacgttgggcattttgaaaagttattcagagaaatgttactggtaggcaggacttttgtatctgatggaggaaaccgatgtagggtttggataaaataagactagcaggctgggcacagtggctcactcctgtagtctcagcattttgggaggacaaggtgggaggatcacttgataccaagagttcaaggttacagtgggctgtagtcatgccactgtactccagtctgtgccacagaaccagaccctgtctcaaaaaaaanaaaaaagggcggccgc

SEQ ID NO: 4511 - DNA, 1342 bp, Homo sapiens
ccacgcgtccgggcgcgcgggtgaaaggcgcattgatgcagcctgcggcggcctcggagcgcggcggagcagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtgagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4512 - DNA, 1286 bp, Homo sapiens
  misc_feature (1284)..(1284): n equals a,t,g, or c
gggcgcgcgggtgaaaggcgcattgatgcagcctgcggcggcctcggagcgcggcggagcagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcactccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaaaaaaaaaaaaaaaaaaaaaaaaaaaaaaaaaaanaa

SEQ ID NO: 4513 - DNA, 462 bp, Homo sapiens
  misc_feature (393)..(393): n equals a,t,g, or c
  misc_feature (433)..(433): n equals a,t,g, or c
  misc_feature (447)..(447): n equals a,t,g, or c
tgctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagagttcgcctgtctcgtcccgaggccgtggctgaggtgaagagcttcttgatccagctggaggccttcctgaagccgcctgtgctgcacatgttaaagccgccctaacgcgtgctgcactgggagaancccgtcgtgtcctcaaagttctatggggtcttcttggcanagtcttcaagccgnatttccggcaatctg

SEQ ID NO: 4514 - DNA, 546 bp, Homo sapiens
  misc_feature (409)..(409): n equals a,t,g, or c
  misc_feature (439)..(439): n equals a,t,g, or c
  misc_feature (506)..(506): n equals a,t,g, or c
  misc_feature (514)..(514): n equals a,t,g, or c
  misc_feature (542)..(542): n equals a,t,g, or c
aattcccgggtcgacccacgcgtccgggmtgggggamtgsccatgttacttgtcagrctgtgctgcccagccctgtttatctgtgtaattatttttgtaaacattgtattctctgtggtcgccacctcctcgcccccagcctcgggttcagtctgtcttccaggcctgcttgcacctcactgggctgctccggggtctctgcccctcattccaggcctggctgtcaggcccagccagcaggggcccgtgacccagcagcctgcccaaagcatttgtttctgggggatggggtgggggctgctccacaggaggtttgagcccagcaccctggggaaggggaccctgcacgacacccccttgcctccctcatgaggtaaaggccagcttccaatggctgcctcggtatgtncaaatggcccagccacatgccctccctctntgagtggagcccttcgaatgctaatcctgaggtattgccgcttggatgaagccgcaacacttacttnacataggngcgcatctgcatggccattgattagcanatta

SEQ ID NO: 4515 - DNA, 1210 bp, Homo sapiens
  misc_feature (608)..(608): n equals a,t,g, or c
  misc_feature (616)..(616): n equals a,t,g, or c
gaattcggcacgaggttgagtgaggctccaagaggtaaagtcacctgccagactctcattgttcaggagcagcagaggtaggatctggacctgatggagtctggagtcagcacccataacatgtcctcctggaccttggggatacactgtgagcaggctggctggggtctgccagcacagataggtgccattctgttttgcatactatttcagggggtcctgaacaccttgaagcaggtggaggcccctgctccagactgggagctcctggagaggccaccctgtgtctgtgtggttctaagctggagccacatcgaatcaggatggggctccagcacccgacagtccccatcaaattcacaggttttggcgccgtcgggcaaggctgacacattgtcttggaggaggcccaggaagtctggccttagggtcgcagcctgagtttcaggcagatagggcatgagattccagcatttctgcttcgagccccgtggtagatccctgtctccctccttccccatggcctatttctgtctcatttattcattaacttcttgaacattcgtgaacacctgttttgtgcacagtgctgggttctgagggtgcancaatgaanaagccaacccakcagcctccattcctgcactgtgaggcgggcaagcaacacaccaatgggacagtagtaaatgcagcacccagggggaggcacctaacacagtgggggattaggggaggcttcttggggagaccagaggatagctgatgagtttcaggcaggacaagaggcttaaaccaaggtctgcgaggtgggagtcggaggatgtcattgtcgcggggtcaggtacaggctgagctaacaagacacacaggaccaaacccctcaaggtcagcctcacagagcaggaactcaggaagaaagcgtttttgtttgtttgtttgtttgtttgtttgtttgtttgaaatggagttttcgctcttgttgcccacgctggagtgcagtggcaacgatctcagctcactgtaccttctacctcccagtttcaagagaaagcgtttttttgtttgtttgtttgtttgtttgtttgtttgaaatggagtttcgctcttgttgcccacgctggagtgcagtggcaacgatctcagctcactgtacctttctacctcccaggttcaagagaaagcgttttaaaaaaaaaaaaaaaaaactcga

SEQ ID NO: 4516 - DNA, 309 bp, Homo sapiens
  misc_feature (12)..(13): n equals a,t,g, or c
  misc_feature (125)..(125): n equals a,t,g, or c
ctggggaagggnnccctgcacgacacccccttgccctccctccatgaggctaaaggcccagtcttcccaaatgtgctgccctcgttcatgtgccaaatggccccagcccacatgcccctcccttntctggagtgggagccccttctgaagtgtctgaatccctgaagtgttcatttgtccgtcctctgtgcagtgacagccccggccaagccacctctaatcctctgtagcaataacggtgcgccgcccatccctgcccattgtgcaccactaggattttaaagtccatagattttaatgaaatttcta

SEQ ID NO: 4517 - DNA, 2377 bp, Homo sapiens
aggggcacgagcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctgggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcaytgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccactttaagatccagtaaatgtctgttctactgtagtattacttaaaa

SEQ ID NO: 4518 - DNA, 1016 bp, Homo sapiens
ggcacgagcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctccccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctcctttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttcctttttgaacaacgcagctgccatgatgccttgggatgccctggtcctgggggactcaggtgcctccctgattcctgtgggaaccccgggttcaggccagggcctccttggaataaatggttattgttactaggtccccaccttccctcttttctggaagccaaagtcaccctccccaataaagtcctcactgccaaaaaaaaaaaaaaaaaaaaaaaaaaaaaaaaaaaaaaaaaaaaaaaaaaaaaaaaaaaaaaaaaaaaaaaaa

SEQ ID NO: 4519 - DNA, 886 bp, Homo sapiens
ccacgcgtccgcaggactgcattttgctccggagcgtccagagtcctggccctgagcgggaatcgcagtggccgaggctgagcggcaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatgaaaaaaaaaaaaa

SEQ ID NO: 4520 - DNA, 793 bp, Homo sapiens
  misc_feature (12)..(12): n equals a,t,g, or c
  misc_feature (55)..(55): n equals a,t,g, or c
  misc_feature (114)..(114): n equals a,t,g, or c
  misc_feature (139)..(139): n equals a,t,g, or c
  misc_feature (174)..(174): n equals a,t,g, or c
tttggcccggcngtttttggttttggttccccaaggggcaaaccccccgggaatncccgggggggcccaattcgggttcccgggtttggaaggccccgcccaatttcggcaccngaagtttgggaaggaaggccccttngagccccccgaagttgttttaggaattttcgcaancggagaagcggtggccacgcggtcccgcctggcagtgagactcacttccgcgtggctgtggtgagctctcgtttcgagggactgagccccctacaacgacaccggctggtccacgcagcgctggccgaggagctggsaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatgaaaaaaaaaaaagggcggcgctcgcgactagaacgcgagc

SEQ ID NO: 4521 - DNA, 773 bp, Homo sapiens
  misc_feature (2)..(2): n equals a,t,g, or c
  misc_feature (773)..(773): n equals a,t,g, or c
gnagcgcgccggcggcccgcgtctccctaggacccgagtcgggcggccggcagcgctccgcctcctcctyctgctgggcgctgtcctgaatccccacgaggccctggctcagmctcttcccaccacaggcacaccagggtcagaaggggggacggtgaagaactakgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaactttttttttgtaaaaaaaaaaaaaaaaaaaaaaaaaaaaaaaaaaaaaaaaaaaaaaaaaaaaaaaaaaaaaaaaaaaaaaaaaaaan

SEQ ID NO: 4522 - DNA, 817 bp, Homo sapiens
ggcacgagggcgcctcttcagcttcctgtaccagagcagccctgaccaggttatagatgtggctcccgagcttctgcgtatctgcagcctcattctggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaataaaaaaaaaaaaaaaaaa

SEQ ID NO: 4523 - DNA, 969 bp, Homo sapiens
  misc_feature (36)..(36): n equals a,t,g, or c
  misc_feature (123)..(123): n equals a,t,g, or c
  misc_feature (347)..(347): n equals a,t,g, or c
  misc_feature (525)..(525): n equals a,t,g, or c
gggaggaacatgatggtgtccgtgacaacatctgtngggcacttgcccgcctgttgatggccagtcccaccaggaaaccagagccccaggtgctggctgccctactgcatgccctgccactgnaaggaggacttggaggagtgggtcaccattgggcgcctcttcagcttcctgtaccagagcagccctgaccaggttatagatgtggctcccgagcttctgcgtatctgcagcctcattctggcagagactattcagggcctgggtgctgcctcagcccagtttgtgtctcggctgctccctgtgctgttgagcaccgcccaagaggcagaccccgaggtgcgaanaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaanccagagccccaggtgctggctgccctactgcatgccctgccactgaaggaggacttggaggagtgggtcaaccattgggcgcctcttcagcctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaataaaaaaaaaaaaaaaaaactcga

SEQ ID NO: 4524 - DNA, 2294 bp, Homo sapiens
ggcacgagatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggcccgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaa

SEQ ID NO: 4525 - DNA, 702 bp, Homo sapiens
  misc_feature (302)..(302): n equals a,t,g, or c
  misc_feature (540)..(540): n equals a,t,g, or c
  misc_feature (551)..(551): n equals a,t,g, or c
  misc_feature (591)..(591): n equals a,t,g, or c
  misc_feature (596)..(596): n equals a,t,g, or c
  misc_feature (646)..(646): n equals a,t,g, or c
  misc_feature (685)..(685): n equals a,t,g, or c
  misc_feature (701)..(701): n equals a,t,g, or c
gatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggcccgcgccggggctcccgccgcgccctygccgcccgcgctkgarctagcgcsgggctycgtggcgccagcccccggcgcgaaggccaagagcttggagggcggcggtgccgggccggtggactaccacctgctgatgatgttcaccaaggcggancacaatgccgcgctgcaggccaaggcccgmgtcgcgctgcgctcactgctgcgcctygccaagttcgaggcgcacgaggtgcttaaccttcacttcgtgagcgaggaggccagccgcgaggtggccaagggcctgctgcgggagctcctgccgccgccgctggcttcaagtgcaaggtcatcttccacgatttgctgtgctgacggataagctcttccccatcgtggaggccatgcanaaacacttcantgctggcttgggaacctactacagggactccatcttcttnctctnggtcggcatggatcaaatcaatggccccaagagaatcctggcaaatcaanttaagcttggaacctaaaaacctggaaagtttaaagaanccaacaattcccgggna

SEQ ID NO: 4526 - DNA, 1411 bp, Homo sapiens
ccccgctctacagccgcctgctggagccggcgcaggtgcagcagctggccgacaagtaccacttccgmggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccstgccttgccccyggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaactcgag

SEQ ID NO: 4527 - DNA, 1550 bp, Homo sapiens
  misc_feature (909)..(909): n equals a,t,g, or c
gccggagctccaccgcggtggcggccgctctagaactagtggatcccccgggctgcaggaattcggcacgagcatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctkctgagtgctgctgggcccgtggctgcccctagggaagccttccgggggcgggcgctcctgtccgtggagtcgggcagcaagcccttcacccggcaggaagtcattggcttcgtcatcggctycatctccagcgtgktgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcanaccgccgcctcggagcttgagcccctcctycccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaaaaaaaaaaaaactcga

SEQ ID NO: 4528 - DNA, 433 bp, Homo sapiens
  misc_feature (317)..(317): n equals a,t,g, or c
gcaagctctacgactcgctgctcgccctggacggtcacatccaatcagcgcgggccctgatggtggtggccgtgctcctgggcttcgtggccatggtcctcagcgtagttggcatgaagtgtacgcgggtgggagacagcaaccccattgccaagggccgtgttgccatcgccgggggagccctcttcatcctggcaggcctctgcactttgactgctgtctcgtggtatgccaccctggtgacccakgagttcttcaacccaagcacacctgtcaatgccaggtatgaatttggcccagccctgttcgtgggctgngactcagctggcctggccgtgctgagcggatccttcctctgctgcacatgcccggagccagagagacccaacagcagcccacaagccctatcggcctggaccctctgctgctgtcc

SEQ ID NO: 4529 - DNA, 1009 bp, Homo sapiens
  misc_feature (145)..(145): n equals a,t,g, or c
aattcggcacgagatcaggcttctggggaaagcatccatcacagaacctccccttccctgccacgcaccttccttggccagctccattctggcctcctccaccacctgccttgtgaccacatctcccaccacgtccccagatctnaagaacgcagctcagcttctccttcgagcttgactctgagagggaaagtgacggaaaccaagtcagatgagatgactgccatgtacactgcagtcaagggcagggaggggaggaatgacacaaatggcagggagctgctggggaactgacccctcggcgcctggcctggccggtgctgcacatccaccggggcacaacagggacttgtccagcctctggtcagaggatgtggccacctgaccctaaataggttccccagagtcctgcccctctaatgaatgagaactgcaggagtttctcctctgggtgcctgaagctatagtgcaatggttcccaaccctgcatgcacattcgaatcacctgggggcacaatgcctaggctccaaccccagacactcttatttcattggtctgggtggacctggcatcagaagtcatgtagctcctcaggggactgtagtgtgtggtcagcactgagggctcctctatgaggcctcaagcccaggtgactctgtgaggtctgcagagggagaaaagaacccacaagggaagaggtggaggtcaggcacggtggctcacgcttgtaatcccagcactttgggaggccgaggtgggtagatacctgaagtcaggagttcgagactagcctggccaatatggtaaaaccccgtgtctattaaaaatacaaaaattagctggctgtggtggtgggcacctgtaatcccagctactcgggaggctgaggcaggagaatcgcttgaactcgggaggtggaggttgcagtcagccaagatcgtgccactgcacaccatcctggatgacagagcaagactccatcacaaaaaaaaaaaaaaaaaaactcga

SEQ ID NO: 4530 - DNA, 530 bp, Homo sapiens
  misc_feature (450)..(450): n equals a,t,g, or c
  misc_feature (496)..(496): n equals a,t,g, or c
  misc_feature (511)..(511): n equals a,t,g, or c
  misc_feature (517)..(517): n equals a,t,g, or c
  misc_feature (519)..(519): n equals a,t,g, or c
ggaaacaaagaaacaaaccgtatatatatatcttagagttaaaaaatggtgagaacaagagcattgttttatatattttttcaactctctttaacttctggcttaatagaagacagctgcattctcattattatttatttatttttttttagatggtgtctcgctctgtcacccatgctggagtgcagtggcgtgaccttagctcactgcaaccaccacctactcgggaggctgaggcaggagaatcgcttgaacctaggaggcggagattgcagtgagctgagattgcaccattgcactctagcctgcgtaacgagcaaaactctgtcacacacacacacaaaataataacaataataataataaaacattgccgggcacagtggctcatgcctgtaatcccagcactttgggaggctgaagctggtggatcgcgaaggcaggagttcnagaccagcctggccaaggtggtgaaaccccatctctactaaaaatnccaaaattagcccancgtggngnacacgccttgt

SEQ ID NO: 4531 - DNA, 882 bp, Homo sapiens
  misc_feature (635)..(635): n equals a,t,g, or c
gaattccagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggastctacaacggcacggccgacatcaccctgcgcttcacctggaacttccagagggacctggcgaagggaggcactgtggagtatgccaacgagaagcacatgctggccctggccccaacagcactgcacggcggcagtggccagcctgctcgagggcacctcggaccagtctgtggtcatccccaatctcttccccaagtacatccgtgcccccaacggncccgaagccaaccctgtgaagcagctgcagcccaatgaggaggccgactacctcggcgtgcgtatccagctgyggagggagcagggtgcgggggccaccggctttcctcgaatggtgggtcatcgagctgcaggagtgccggaccgactgcaaccttgttgcccatggtcattttaagtgaacaaggtcagcccaccgagcctcggmttcctggctgrctamgggtgagtgagtggctgggggggca

SEQ ID NO: 4532 - DNA, 1090 bp, Homo sapiens
  misc_feature (4)..(4): n equals a,t,g, or c
  misc_feature (17)..(17): n equals a,t,g, or c
  misc_feature (47)..(47): n equals a,t,g, or c
  misc_feature (1033)..(1033): n equals a,t,g, or c
gatntggcgatacattnacacagaacagtagacatgatacgccaagnttaatagactactatagggaaagctgtacgctgcagtaccgtccggaattcccgggtcgacccacgcgtccgcgcggctcatgcccccagtatcccggtccagctattccgaggacatcgtgggctctcggagaaggcgacgcagctcctcggggagcccaccatccccgcagagcagatgttcctcttgggatggctgttcccgctctcactcccgcggccgtgagggccmcaggcctccttggagtgagttggacgtgggcgctctttacccctttagtcgctctgggtcgcgagggcggctcccaagattccgcaactacgccttcgcgtcctcctggtcgacctcgtatagtggatatcgctaccatcgtgcactgctatgcagaagaacggcagtcagcggaagactacgagaaggaagagagccatcggcagaggaggctgaaggagagagagaggattggggaattgggagcgcctgaagtgtgggggccgtctccaaagttccctcagctagattctgacgaacataccccagttgaggatgaagaagaggtaacgcatcagaaaagcagcagttcagattccaactcggaagaacataggaaamagaagaccagtcgttcaagaaacaagaaaaaaagaaagaataagtcgtctaaaagaaagcataggaaatattctgatagtgacagtaactcagagtctgacacaaattctgactctgatgatgataaaaagagagttaaagccaagaagaaaaagaagaaaaagaaacacaaaacaaaraaaaagaagaataagaaaaccaaaaaagaatccagtgactcaagctgtaaagactcagaagaggacttgtcagaagctacctgggatggagcagccaaatgtggcagatactatggatttaatagggccagaagcacctattaatacatacctcttcaagatgaaaaacctttgaagtatgggccatgctttgnttcccggtggaaggtgcagctatggctgagtatgttaaaagctgggaagcgattccc

SEQ ID NO: 4533 - DNA, 731 bp, Homo sapiens
ccacgcgtccgagacgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctcaaaaaaaaaaaaaaaaaaaaa

SEQ ID NO: 4534 - DNA, 1378 bp, Homo sapiens
  misc_feature (271)..(271): n equals a,t,g, or c
ggcacgagccgctccctactctgggggttgggactacctccttttccgcgggccccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgantctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaascakkgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacataaaaaaaaaaaaaaaaaaaaaactcga

SEQ ID NO: 4535 - DNA, 804 bp, Homo sapiens
  misc_feature (800)..(801): n equals a,t,g, or c
aagaaaactctagaagtctggatgtcggtgggcctctgagatatgccgtttacggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcrctgccttcaggtggtgctgccccagaaacttaaaatttagtcgaggcagtttcaattgttactgtggaccgaattaggatcacaataaacgataatgcaggttcttcaaaaaaaaaaaaaaaaaaaaaaaaaaaaaaaaaaaaaaaaaaaaaaaaaaaaaaactcgagggggggcccgtacccaatcgccctgatgatgatctgnncac

SEQ ID NO: 4536 - DNA, 2347 bp, Homo sapiens
ggcacgagggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaagctttggccagagtgaagaattcttctactctactgggactgagctaatcataccgtgaaggttactgcaggcccatcacaacaaaacctataaacaagcctactaggataaagctgatgcaagtaacttaacttcctgccagtataaaactcaacactttttaaatgacaacaaaatcgagacactcgataatgtagaaataacaatgttcagcatccggatgaaaatttttagacatgtgaaaaagcaagagaaaactcaagcaatgaaaatcaaactataagtgaaacctccttaaaacagctttttaaaatattttcaagattacagaaaatggacataatgaaaacaggaatggaatttataaaagagaattgatggacaaaaagaacaaatgaaactgaggagctacaaaaataccatagctataataatctactgaatgagcttaagagcaaattaaataccacagaagaaaagatagatgaacttgaggatagaatgataaatcctacccaaattgaagcacaagaagaaaagaaattgaggaagaaaaaaaaaaaaccactgaaccacataagctataggacagcttcaaaaggtctaacagaagtataactggagaaagatgtgggcatagacaaatgtatattaagaaataacagccaaatggtttcccaaatttgttgaaaaatataaacaccctgtccaagaagtttaacaaactccaatctaaacaaacaaaaagaaagtcccacaaaaacacaatataattaaaaaatttgaatatcagtgatagagaaaaatatttaaaacagtcaaataaaaagacacattatgtgcaagggaacagtggtaagaattatcacactcttctcaccagaaatgaatgccattcaaaaagcaataggataacattattaaagttgcttctcaaagggaaaaaaactatgaacctataattctgtatctgagaatgtaggtagaagaaatgaaggtcaaataaagatattatcagatacgaaagactgagagaattttgcaccagcagacctgcactacacaaatattagaggatgctcttcagacttaaggaaaatgatttcaggtagaagcttagctctacaaattacaagctcttgaaatgagattcaccttttttctatctctgtatgaagttttgtgaagatattatgtcttcatgtaagaagctgcagcagtttcttgcgaccgtgagagaacaagcatgaaggtgaacaccgatgatgcattgagaacaacattgagaaaacacctgtgtaattgtgcattgaattagctaacctggaactgctcatctttggatttttttgttaagtgacatgttcgacattgatagagcagtcagcattaaaatctgatcaaagaaacaggcagtttcacatccttcatagctgagtctttggaatacattggtatgcttatatcttcagcattattctttccattgattaataactgtaatctaaaatctttaattcttttttatttttgaatagatattcattagaataatgaaagagaaaatgtacactttaagaatttcttctacttaacgtttttaaagattgcctctttatccaaaaaacagtataccatttataaatatttaactgtatatcatacaaatgcctccagttttatccaaatccactgttaaattacccatgtaattattccagtagaaatcattatacctttttattgttaatttcatcaatgctttactgtaaagagtctaggtgtacttaaatgcagttctcagagttcttcttatgacaattaaatggaacatttccatattattttggtgggggacgatgtgtatatttactgtttaaagtgtaacaaaaaattattagccactaacaatatagataaaaaataaatggccaatagacttaaaaaaaaaaaaaaaaaaa

SEQ ID NO: 4537 - DNA, 502 bp, Homo sapiens
  misc_feature (435)..(435): n equals a,t,g, or c
  misc_feature (463)..(463): n equals a,t,g, or c
  misc_feature (478)..(478): n equals a,t,g, or c
  misc_feature (489)..(489): n equals a,t,g, or c
gggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaagctttggccakartgaagaattcttctactctactgggactgagctaatcataccgngaaggttactgcaggcccatcacaacanaacctataaacaagnctactaggatnaaagctgatgcac

SEQ ID NO: 4538 - DNA, 718 bp, Homo sapiens
  misc_feature (112)..(112): n equals a,t,g, or c
  misc_feature (497)..(497): n equals a,t,g, or c
  misc_feature (507)..(507): n equals a,t,g, or c
  misc_feature (516)..(516): n equals a,t,g, or c
  misc_feature (585)..(585): n equals a,t,g, or c
  misc_feature (606)..(606): n equals a,t,g, or c
gtcccggccttcggaagaaccgtccgtcagttccccgaaggagttccccggggagaatctctggtctcagttcggttgcatggaatccggatcatagtatttccgttttttncttggcygagcttacgagtcgtgcgcagctagcagttggggtatcgtagggcgggagccagctttagagaattagtgcatcgctatttccggtgagttcctgcattgtgtattagcagttgttatttaagttcgttggtggatctggtatggggtatttggttattttttgtttttcggtgcgtgttagttgcggtggtcgggcgcggggtctgagatttggcggtttattatgattggactttttgggcgttcaatatttgtaaggggggagctgtgaagtttgtgggtgtttggatctgtgtagtgagggtcaataagcattttgtaagggtaagatcattgggttgaaagtctggttgttaaggtgcgggtaagttgtgaantttttgttcnttggtttangtaggtcagtttgatcatgggctgcatatgccatcatgaattgggtcagcattatagcgcattaattanttgtcgaggttgggtccggangtttaaagtgttgattttccatcccccgactgatcatcatgatgtttgaatcatttgggcatcatggaggggggttgttgcaagaatggaggatgatgcgtggggggatggg

SEQ ID NO: 4539 - DNA, 1163 bp, Homo sapiens
  misc_feature (673)..(673): n equals a,t,g, or c
ctacactatagccctcagaaggacgacttttttctcttttagcaagatggcagttatagccagaggacagctcaggttggtgctttgctgggatttagttaatatgatgatgtatacatattttatattcagctctttacagtgaatgtaaaacaaatgtaatttaagggattagtaatatatacttgtacagtcattattgagtcttagccatttatactctgtcagagaaaatctgcctttgctgttcgtgtgtacctagaatgaaaacaattacttagaatgaaaccattttcttctccttttcaataggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgnttgcttttatttatctggctttgcagaarcgtcaaatactttctgaaggaaagggtgaacctcttttttcaaacaaaatttcaaattttctgktgkttatttcagtagtttctttcttgacctattccatctgggctagcagttgtaaaaacaaagcagagtgcaatgaactccatccgtctgkttctgkggtacagawtttagccttcatcctaataagaaacatccctggatatgcccgtcagtttacagttcattttttgcttggtttggaaaaatttcattagagctatttatttgccagtatcacatatggctggcagcggacacaaggggtatcttggtactgatacctgggaaaccctatgctcaacatcattgtcagcactttcatatttgtttgtgtggcacatgaaatttctcagaatcactaatgatcttggcacagattattattcctaaagatgaactcatctctcttggaaaaggt

SEQ ID NO: 4540 - DNA, 688 bp, Homo sapiens
  misc_feature (686)..(686): n equals a,t,g, or c
gggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacmwcctattttaaatatttatcagtctaaacttgtgcagtgtagtaaacatgcaagttgttatgattgagctgtattaccataagtagaattttaagtaaactggtgaatttgggccatagatgtttttgctttttgtttgatttttttttacaarmwaamtgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaacaaacattctgtggatgcttatttttgtattggcaaagtatcaattaaactatatgtgttctttttcaaaaaaaaaaaaaaaaactcnga

SEQ ID NO: 4541 - DNA, 3505 bp, Homo sapiens
gaaggaggtgttttgtgaccctttcgccatgattgtaaatttcctgaggccttcccagccatgctgaactatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgccygactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcrgattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaaaaaaaaaaaaaaaaaaaaaaaaaactcgagggggggcccggtacccaatt

SEQ ID NO: 4542 - DNA, 1117 bp, Homo sapiens
ggcacgaggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtaggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggcgattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacacttagaaaaaaaaaaaaaaaaaa

SEQ ID NO: 4543 - DNA, 2882 bp, Homo sapiens
gtcgacccacgcgtccggacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtrggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacacttagcaaaaaaaaaaaaaaaaaaaaaawaaaaaaaaaaaaaa

SEQ ID NO: 4544 - DNA, 1160 bp, Homo sapiens
ggcacgagtcgtccagcccgcggcgagagcgggtatgtgggcgggaggccggagcagctgtcaggctgaagtcctgcgagcgacgcgcggcggggcggcgagaggaaacgcggcgccgggccgggcccggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttaaaaaaaaaaa

SEQ ID NO: 4545 - DNA, 1115 bp, Homo sapiens
gggctgaagtcctgcgagcgacgcgcggcggggcggcgagaggaaacgcggcgccgggccgggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttaaaaaaaaaaaaaaaaaaaaaaaaaaaaaaaaa

SEQ ID NO: 4546 - DNA, 1403 bp, Homo sapiens
tcgacccacgcgtccgctgaattgcggccgtatgcgcggctctgtggagtgcacctggggttgggggcactgtgcccccagccccctgctcctttggactctacttctgtttgcagccccatttggcctgctgggggagaagacccgccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggaaaaaaaaaaaaaaaaaaaaaaaaaaaaaaaaaaaaaaaaaaaaaaaaaaaaa

SEQ ID NO: 4547 - DNA, 781 bp, Homo sapiens
cggcacgaggcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctcaaaaaaaaaaaaaaaaaactcgag

SEQ ID NO: 4548 - DNA, 2753 bp, Homo sapiens
ggcacgaggtctccctcccgcgcgatggcctcggcgctgagctatgtctccaagttcaagtccttcgtgatcttgttcgtcaccccgctcctgctgctgccactcgtcattctgatgcccgccaaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgttaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggacatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcagatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaagcccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaaaaaaaaaaaaaaaaaa

SEQ ID NO: 4549 - DNA, 2756 bp, Homo sapiens
ggtctccctcccgcgcgatggcctcggcgctgagctatgtctccaagttcaagtccttcgtgatcttgttcgtcaccccgctcctgctgctgccactcgtcattctgatgcccgccaaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccakatgaacgagttgtttcctgacagcaaggacctcgtgaactttgcttcctggtttgcatttgcctttcccaacatgctggtgatgctgctgttcgcctggctgtggctccagtttgtttacatgagattcaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgcygtgttcactgagtgcacaagcaacgtggccaccaccaccttgktcctgcccatctttgcctccatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggwcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcagatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgcacccacagtgcaccacaggccaacctackcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggycctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaagcccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaaaaaaaaaaaaaaaaaaaaaaaaaaaaa

SEQ ID NO: 4550 - DNA, 548 bp, Homo sapiens
  misc_feature (362)..(362): n equals a,t,g, or c
  misc_feature (445)..(445): n equals a,t,g, or c
  misc_feature (509)..(509): n equals a,t,g, or c
  misc_feature (526)..(526): n equals a,t,g, or c
  misc_feature (530)..(530): n equals a,t,g, or c
ggtctccctcccgcgcgatggcctcggcgctgagctatgtctccaagttcaagtccttcgtgatcttgttcgtcaccccgctcctgctgctgccactcgtcattctgatgcccgccaaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcanatggaagccacaagcgcagccaccgaggccggcctggagctggtggacaagggcaaggccaaggagctkccagggagtcaagngatttttgaaggccccactctggggcaacaggaagaccaaagagcggaagaggttgtgtaaggncatgaccctgtgcatcntgcnacgcggccaagcatcggg

SEQ ID NO: 4551 - DNA, 1591 bp, Homo sapiens
aacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggwcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcrgatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgcacccacagtgcaccacaggccaacctactcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggycctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaagcccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaaaaaaaaaaaaaaaaaaaaaaaaaaaaaa

SEQ ID NO: 4552 - DNA, 1556 bp, Homo sapiens
  misc_feature (292)..(292): n equals a,t,g, or c
  misc_feature (1519)..(1519): n equals a,t,g, or c
caggtgaagaaaatcaccttctccattccccttgatttctttatcgtgtgccgcacgaggcatgctgaagggacacacacctttccccctttttatttacaaagtagagagctgagaaagacagctcatgttctgttttgttttgtacacattatctttctcaagagatgtgatgtccttaagtaaactgacctgccttcatggcttgtcctgtaatgaatgcgttcaagacagtgtttyggggacaggaaagaggcattcttaggtaagcggcggtgggggatggggtggngtggagaggaaacccttctaggaagtagttcaatgaaaaacctaaaaatgcccaaataaacattcgcttacatattatatatcttgggcttctttttatgacagttcattcagggacccagtcagtaaacaggtagttaacttcgtgtaaccaagcaagggttttgtttatcttttttaaagtagaaaaaagtgaggctcaaactctctctttctccttgtcataactattggtttacagtctttatttgtttaaaagtaaagcacattgtatgtatttatttggcaatacatgaggccattaaaaccctgagcctaaggtaccacagttagtctcatttgcctcttgtcctgtgaactccacttagaatgtcattgaacttgggcagacataattctagtgtctgttccaaacgcactgtgtcacagaagctagaattaccattagaggcacaaacccctgagaatacacaagggggcacgcttccagtagatgtgttggggaaggaggagggcagaggggacaggggacaggattcagctttgtggtgggtcctgagggttcctaccaggggtagccaggatctgggaaacagatcagcgactctagtctgaagtggctgcctggttcgggggctgccttcagcaagattcaggcaggagagacggaaatagccaccttccaggcgtgagtcctggagataaaaatggattttaacctaggactgccgggagctggccctccgcggctgctcagactagggctgtgtgtgctggctctcgcctgtttccggtgtctaactggcttgtttctctttatggcttggcttcattccgacctggggtggggccacatccaacccactgcccactggctgtccgtctggcctgccccgcggttccaaccacagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccytggagtytktaaggmcctttttgaacattcaggagaacgtgggccctttngttgggccaacatcagcgggccggttgttgggtatgg

SEQ ID NO: 4553 - DNA, 4990 bp, Homo sapiens
  misc_feature (4986)..(4986): n equals a,t,g, or c
tggatcactctgcgcctgcaggtcgacacgtagtggatccaaagaattcggcacgagcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccrgcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaaagttatctggacagcttctttgagactatttaaaaactggtacaacaggtctctacaacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaawgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtggtgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttsctgatttcctcttctcttgcccagtttttttttttttttttttttaaagcctggattgtaaccagattttcttttttcccccttctcagctgtagatatgatatctcctttcagggccccagcttaagggcaaagtgagttaatgtgtagacaaaggcgagggacaagagagagttaacatctagacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctggtagtacattttgcttcttagaaagctaagtcctgggttccgtctgattttaggttccaggaacttcctgagaacacccgatcgcagagggtaattttctggagtttgttttgcagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcattttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaattatgtatataaaagttgcattacmcagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggmaggatctcgcccgytggagggtggtggagcccagtaraattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcggaagacccctctccagaagccattctgcatccttgtctgctctgcgtcamccgagaacacaggcttcgcagcctcgctttctgaaatggtgtgtgccgagtcagattgccgctcagagaaaatacaagcccgttttccctagctgtgccatttggtgctctgccaggctgccgtgcaagggaataccgacgagacgagctgcactgtctctgatttggagccctcamcggwgcttgtytttaaaatgagcaggaagytcatgtratgtttgcatttcatgagccgggtnctga

SEQ ID NO: 4554 - DNA, 2382 bp, Homo sapiens
ggcacgagctgggagttcaggtgaacactattgtgaattccgtttaaaaggagggctcccactctccttgtctgcatcagccacatatcccatggctgcagcaataactcccctcttgggaaagtcagcagcaggagaagcccaaggcagaagggatgtgaccaggtcccagcctatgacatctcatgaaggctcctcctgtgtgctgcaaggcagcagcagtgcagaggatggggtctcctctacaattcaattattttacaccaaacccagtactacttccctccaggaaagggggcgcatggatggcctggacaaagctgcaaggagggcaaggctgggcagggtactgcatcttcaggctgcttctgggctctgccaggaagcacaggctcaggagaacagagtggggcctgaatgcacacatgtgccatctcggggccctgggccaggtctgagttgtcaaacaagaacagatgcaccactggctacatggtcgtcaatgactccccagtctcaacagagagaaagaaagtgagagtgattgctactttccattccacgcttaatgtacaatttgatcagttaaaccacttaatcctatatgaaacaggaatgtgaagacaccttatgaaatgaaaaatgttaacctcatgggtaaggatggcgatcagcaccgtcattctggtgatgaaccccagaaggccagcgccctcccaacaccaatgatgctggatgtcagcttgctgtttgcatggctaaggtcgcttctggccatttattctgggcttgtcacaaatcccatggagcaagactctgctctctcctattcctgtggagatcccaaggcccaatccccagggaagttgtacctaaaggcttcccagaagataccagaaacgacgacaccagcttcaaagaagaggctggatgctccctccttcaaccatccaggtctgatctagggatacgatgtagttcagacacattgtcccactaatatggccttgacatacacaggctttgggccccatcaagcctggctccacagctgtctctggaatccacggcggagctgctcaccacccagggcagagttctccatccacagttggaagtcacaaccacacaccctgctgcaggtcaaggcttcccctactcgctcaatgtaagaggacgctgctcatcgctctggaggccacagagaacaagaggcataattcctgcccacagggagtgccccggggcgctgctgtgtaagccactgccacagctggagagcctgaccctgcgggattcagcgaggcccacgcagcacaaactgcccaagtggcctcaaagtcaggaaaagatttccatgaggtctggagcagccaggaaggctcattggaagaggccagacctggcatagccagaaggaagggggaggatggcaggctcttcaggctcagggcagtgcggacagtgagcccaggatgcccaattgtgccctggcactgaaccgagtgaagtgtaagccccggtgcaaagcatgtggcctctcctatacatacaggatgaggaacatctcttgctggcgtcctcgagaggaacacatgatgtaatacacatagtaagaggtacatgatgaagcacccactaagccctgatatcggggtttctcaggctgttgctgggccctgttgccagagctcctgcctcagtgagcctgggcatgtctaacaggttcccagtgatgcagatgctgctgctccagggaccaccccgggagggagactcacaggccctttggcatttccacacttgctgtggctccatagttcccagttgcacagtaaggaaggggaaatcatttatcatgtccatgcgcctactaggcattgtactaactggagaaactcaacacagaagatcagagaggcgggagtgggggagacatttgaatcctggtgaccatttaccagtgcttctgagcagcagctgcaaggggtctgggtgccactgggaatgcaggtttggaaggcatccaggggtctgtgcttttcgatggtacatgaatgaaagtgcacaccagggctgggagaggctgccagggactttctccccttgctagggagccttggtctgttctgagatcctgacactttcaaaggccagcccttcagccacgtgagcccaggtgaccaggtgttcgttcgcaaatgaggacgaagtcactggcctaagcatcagaggtaggaagcaccaaaagagcacgaatcatggaaaacctccttccccagggccttatgcaaatggcaccatgattttcaataataagccacaggacaggagaattccactcgtgccgaattcgatatcaagcttatcgataccgtcgac

SEQ ID NO: 4555 - DNA, 1523 bp, Homo sapiens
  misc_feature (990)..(990): n equals a,t,g, or c
ccgggcccccccctcgaggtcgacggtatcgataagcttgatatcgaattcggcacgagtggaattctcctgtcctgtggcttattattgaaaatcatggtgccatttgcataaggccctggggaaggaggttttccatgattcgtgctcttttggtgcttcctacctctgatgcttaggccagtgacttcgtcctcatttgcgaacgaacacctggtcacctgggctcacgtggctgaagggctggcctttgaaagtgtcaggatctcagaacagaccaaggctccctagcaaggggagaaagtccctggcagcctctcccagccctggtgtgcactttcattcatgtaccatcgaaaagcacagacccctggatgccttccaaacctgcattcccagtggcacccagaccccttgcagctgctgctcagaagcactggtaaatggtcaccaggattcaaatgtctcccccactcccgcctctctgatcttctgtgttgagtttctccagttagtacaatgcctagtaggcgcatggacatgataaatgatttccccttccttactgtgcaactgggaactatggagccacagcaagtgtggaaatgccaaagggcctgtgagtctccctcccggggtggtccctggagcagcagcatctgcatcactgggaacctgttagacatgcccaggctcactgaggcaggagctctggcaacagggcccagcaacagcctgagaaaccccgatatcagggcttagtgggtgcttcatcatgtacctcttactatgtgtattacatcatgtgttcctctcgaggacgccagcaagagatgttcctcatcctgtatgtataggagaggccacatgctttgcaccggggcttacacttcactcggttcagtgccagggcacaattgggcatcctgggctcactgtccgcactgccctgagcctgaagagcctgccatcctyccccttccttctggntctgccaggtctggcctcttccaatgagccttcctggctgctycagacctcatggaaatcttttctgactttgaggccacttgggcagtttgtgctgcgtgggcctcgctgaatcccgcagggtcaggctytcagctgtggmagtggcttacacagmagcgccccgggactcctgtggcaggaattatgcctcttgktctctgtggcctccagagcsatgagcagcgtcctcttacattgagcgagtaggggaagccttgacctgcagcagggtgtgtggttgtgacttccaactgtggatggagaactctgccctgggtggtgagcagctccgccgtggattccagagacagctgtggagccaggcttgatggggcccaaagcctgtgtatgtcaaggccatattagtgggacaatgtgtctgaactacatcgtatccctagatcagacctggatggttgaaggagggagcatccagcctcttctttgaagctggtgtcgtcgtttctggtatcttatggaaagcccgcagg

SEQ ID NO: 4556 - DNA, 658 bp, Homo sapiens
  misc_feature (565)..(565): n equals a,t,g, or c
  misc_feature (613)..(614): n equals a,t,g, or c
ggagtaagcctgcaccattttccagctatgtcagtccaggccccagttggcccttggccccttggagtccagccacatactgtgtaggatccaagtgccctgctcgccagagatccagcactcttaatggcaagagtcagatggtgggggttcaaatttggactcttacctgctgtgtaatcttggttgtagtactccccttctctgtgcctcactctctcatctgtagaatggggttaatagcaacatctgtccttcaggggcatgggaagagtaaaatgattaatgccacagtgtgcctggcactgggcctgcccagagtgcccagggaagatcagctgatagtctcacttgacccgcagagctcagaatcagcatccctggaagccttgttaaaatacagcttccttggcccgccctcactgtttcccattcagtggtctgggctgggtctgagcataagcgtttcttaccagttccaggtgacgctggttccactggcctggggacccaactctcaggacccttgagcctgccatccatttcagtgggtmcmctgggacgntgatatatgggaaaggcaaatggtgacctcagacatttcaggaaagcnnaagaaatgtaagccaagggaatttctacgggttttaaggaaaaa

SEQ ID NO: 4557 - DNA, 474 bp, Homo sapiens
  misc_feature (106)..(106): n equals a,t,g, or c
  misc_feature (150)..(150): n equals a,t,g, or c
actgtccccagagaggccaggttggtacttgtacaggtgcagtgttaaacggtcaagaaagcctgatgcttagggcagggggcactgaggaggagtatgcatggtnaggggcttcctagggagcatcagatgcgtaggcattcataaktnamagacacacagggcagggtgagagggaggcatgaagaatggggaggaaggagatggaggaaggaggggagtgagcagagggccccgggaatggcctggaaaaggctgagcccttggatcctctgggttggtgcatctgggctcacctcaawrraatgaacatggtttccaccgagtaaaattatcagcgtgttaacagctgccccccaaacagctggggatgcattcccgccctgcacatgcagacagcagcaacatttgctcaacctgggagcttaagagacaggcatgaaactaaatcttccaaatccattgaggtgagcc

SEQ ID NO: 4558 - DNA, 1073 bp, Homo sapiens
  misc_feature (939)..(939): n equals a,t,g, or c
  misc_feature (1021)..(1021): n equals a,t,g, or c
  misc_feature (1068)..(1068): n equals a,t,g, or c
gatcacacacagccttgagagctgtagacaatggagccctctctggtacacatcctggtttgggtgagtgttccgccccttttcctgtgcttaactcactccagaagcatcaaccataaccaagatggactaaacttaactccactcttgcagatgccccatcaactcacagatgcaagtggtgtcatcaaagccccagcatgtcacccaaccgttaacaccaatccacataaagaaaatgagcatgcattcctgtttgctggatgctgcacacattctttaaacagagtaggcacttgggtgccacctttattcaaggtcttcaggtttcttttacgggggacatctgccatagcaactttcagtgggcatttcttttctgatgaagctttctatcctggggagccagggagactccaaggcaatggagtcccctggcagctcactgtcacaggtcaaggttttgattatgacaaagaagataaaagaagagaagcccctcatggtttgtggctgcagcattacagggctgccagagaccccagagcatgggtgtcttggtggtccacattctgtgatccaggggaggaaccctgaggagtagggaactgcccaccagaagagcactcacaacacactcaagcttcttgacatacaattccagatgtcatctctaaattcacagtgaccttttccctaaactatgttttgatacagggcgagcagaagcgaggggtgatacacagcaacatcggtgagcatctgagctcgcaaggaggcagtggcctctgtgccccctcttcccacccgtatcttaataaaatttcctaaggataattatttagattgkctctcttttgkgkcttawgkawttaatggcagarctgctatgaggcaaaaagaaacaaacaaacagaaagctctttttaaaaaatgcangaggagaaatatgccaggaaaggctactatttgacattaggcattcctgggataactaggatttagctaacataaaaatttncatgttttaaaaagtatctctgatttaaaaataataacaaatctggntacag

SEQ ID NO: 4559 - DNA, 260 bp, Homo sapiens
aaataaataaataaataaataaataaatagtcaattaccttaatctgagcatggagtcatttatcaattttgctgaactataaacttcaaaggcaggaatggcatctctttacatattttgagtttgtgtgtaattgtttagattaggtgtgccccttggaggtggtgatatagaagcagacacctgaaagaagtgaaagcaatccctgagggtatggggaagtgggaaacctccaggaagaggacacggcagatacaaa

SEQ ID NO: 4560 - DNA, 1427 bp, Homo sapiens
  misc_feature (1341)..(1341): n equals a,t,g, or c
  misc_feature (1343)..(1343): n equals a,t,g, or c
  misc_feature (1408)..(1408): n equals a,t,g, or c
  misc_feature (1412)..(1412): n equals a,t,g, or c
  misc_feature (1414)..(1414): n equals a,t,g, or c
tccagtraagggaatcgggaaatgtgatattttaaaaatggtacttaagatgttgcttggtataaaaagaccagggactttggaatcagagcaactgggttcaaatcccatctctgcccttcactaccctggggatcgtagragtcactcagtamcmcaaagataagaaagctacccccaggggctgctgtgttatgtgagaaacactttaagcccccagtgcctgtggtagtaccagaggtcggctctcaatggcacccctttccataaatccgtattgttaattgtagcgtttggttttggttttcatcaacattctactctcacaatgtggtattgtcttgggatggtctatctgggcatctggctctgccaggagaagatgagtttcttgaggacatggactgccgtgtccccagcgtgggtggcatgcctgtcgtgcaggggactgttgatcaatgataatgggtgcatgcatctagcagagacacaactgktctgtacgggcaggaaccccaagggatggtctgttctgttctccgtctctgcacctcaataccccaaaattgkttctgacagatggatgkttarcatgktcttgaaggaagaagcgtctgtgccccctctagggaaatgcacgctgggtttaaccgcataattcaaamcaggtgaaatgatgccggcatacccacytcttctagcctggattctgttttaatgccctagcttttacarraataaaagagtattgatttttccactgcaagggctgtagccagatttgttattatttttaaatcagagatactttttaaaacatggaaatttttatgttagctaaatcctagttatcccaggaatgcctaatgtcaaatagtagcctttcctggcatatttctcctcctgcattttttaaaaagagctttctgtttgtttgtttctttttgcctcatagcagctctgccattaaatacataagacacaaaagagagacaatctaaataattatccttaggaaattttattaagatacgggtgggaagagggggcacagaggccactgcctccttgcgagctcagatgctcaccgatgttgctgtgtatcacccctcgcttctgctcgccctgtatcaaaacatagtttagggaaaaggtcactgtgaatttagagatgacatctggaattgtatgtcaagaagcttgagtgtgttgtgagtgctcttctggtgggcagttccctactcctcagggttcctcccctggatcacagaatgtggaccaccaagacacccatgctctggggtctctggcagccctgtaatgctgcagccacaaaccatnangggcttctcttcttttatcttcggttgtcataatcaaaaccttgagggtgttcccagacgagatncgtngngagccttcccgtt

SEQ ID NO: 4561 - DNA, 2306 bp, Homo sapiens
gtcgacggtatcgataagcttgatatcgaattcggcacgagctggtactatcaaaactcaacagtataaggtatggatttagtatacttattaaatgaaagatatcctataatatgacctgtgaatggattaaataaaaggtatgtacagttataaaattccataacaacagacatgcaatttatttttttattttttaacttcttgccttttaataatatctttgaatatagatggtttcaattctccaataacaagatgtagagtggccaaatggtttttcatacatgtttccctagtccagacacccaagagtatgtccctctcttgggcataagaaaacctagagttatatttagggcatcatgtgtggtgaatagttgaccaagctggcatgctcacaatgaccaaattatgtttgtcatattttaatccaatacattgatctactatgaacttgtaaataatctatttgctttctagacacattccaggaagaccagagaaactgacttttatccatatggaataatccactggcaaatttcttttaggacagaccaaagctgatctataacataatctttacatacttggatccttcccatcagacgagaaagaacatctggggtgaaaggctccattagaagagcaatgtgggatggtcctgtcctgacaactggtagttcctgccctacgtctttgtagaggactggagcccagagcatgccatggtcaactcgtatgttgaagtgaagacctccttcgaggtgtgcatgtgcttattacagatatgccacggtgctaagtaccccaggactacatgaaaaaataagaatagatgctgtatccatgatcatgaggcacacaggccagagcgccagctgtggaatcgcacagcctgggttcaaagcctggctgggccatgaccacctgaatgacctgaggaatggtctcaggcaaatttgtaaaaagtggagaccctgcctgccagggaggcatgtggtaagaggtgcatccagtcaggtcagggcactgcgtcctctctttggaacctgcggagcaaggctggtggcccttgaggccacggcagccatggagaaggcgggcctggctccaggtggcacagaggcactggagaggccccggggaagcctggcgcgatctggctggtcctgcgctctgcttccaggttctggccctgtaacctgggggacagggccggccaaaacagggccactgggtgctagccagcacctgggccaggcgccaggtggaagggctctggcggatcagcctcgcacccccaacagccccacaggggggcccatccagggccacacacttgcccccaggagcaggatatccctgaggctagagtccagctggaccggtggaagggtctcaccctttgccctttgactcctcttgtaggcaccctcgctgggctcctaagcactcctccacacactggctctgtcaccagccccatagtgatgtcataaactcccagatgcccagtgtgcacccagccacagagaagtgggtgacttaggagtatcctctccgcttctgacccttagtttcgtctgtgcacaactcactcaaaatgggcaactcgctaagcgtattttgttcctggttctgccgcaggtcctggccatgccatcggcaacctgctcgtcttgtccgtgaggccttcccagctggccgggctcaccctgcagctcctgcacctgtgcctgcccggggaattgtgggccgtttcccactcctcttcaaccgtcagcgacatcttgggccttcttttccagtcaggtgggacggcgcccctatgaggctgtgtcttatccctcggaacacgggcaccccacagagggtcctgcgtcctgtggtctggagccccccctcaaggaagaaacccgtgctgtctcctcacaactccataatgtttggacacctcagccccgtaaggatcccttgtctcagaggcaagtttaaccttcaacttccttcattagatgatcaggtgatcccagccaggctcccgaagacggaggtgagcgcagaagagcccaaagaagcaacagaggtgaaagaccaggtagagacccaggggcaggaggacaataaaaggggcccctgtagcaatggggaagcagcctccacctctaggcccctggagactcagggaaacctcacttcttcctggtacaatcccaggcccttggagggaaatgtccacctcaagagcttgacagaaaagaatcagactgacaaggcccaggtgcatgcagtctcgtgcc

SEQ ID NO: 4562 - DNA, 391 bp, Homo sapiens
gactgcatgcacctgggccttgtcagtctgattcttttctgtcaagctcttgaggtggacatttccctccaagggcctgggattgtaccaggaagaagtgaggtttccctgagtctccaggggcctagaggtggaggctgcttccccattgctacaggggccccttttattgtcctcctgcccctgggtctctacctggtctttcacctctgttgcttctttgggctcttctgcgctcamctccgtcttcgggagcctggctgggatcacctgatcatctaatgaaggaagttgaaggttaaamttgcctctgagacaagggrtcccttacggggctgaggtgtccaaacattatggagttgtgaggagacagcacgggtttcttccttga

SEQ ID NO: 4563 - DNA, 769 bp, Homo sapiens
gaggtcttcacttcaacatacgagttgaccatggcatgctctgggctccagtcctctacaaagacgtagggcaggaactaccagttgtcagcacagcaccatcccacattgctcttctaatggagcctttcaccccagatgttctttctcgtctgatgggaaggatcyaagtatgtaaagattatgttatagatcagctttggtctgtcctaaaagaaatttgccagtggattattccatatggataaaagtcagtttctctggtcttcckggaatgtgtctagaaagcaaatagattatttacaagttcatagtagatcaatgtattggattaaaatatgacaaacataatttggtcattgtgagcatgccagcttggtcaactattcaccacacatgatgccctaaatataactctaggttttcttatgcccaagagagggacatactcttgggtgtctggactagggaaacatgtatgaaaaaccatttggccactctacatcttgttattggagaattgaaaccatctatattcaaagatattattaaaaggcaagaagttaaaaaataaaaaaataaattgcatgtctgttrttatggaattttataactgtacataccttttatttaatccattcacaggtcatattataggatatctttcatttaataagtatactaaatccataccttatactgttgagttttgatagtaccagctcgtgccgaattcgatatcaagcttatcgataccgtcgacctcgag

SEQ ID NO: 4564 - DNA, 1897 bp, Homo sapiens
  misc_feature (35)..(35): n equals a,t,g, or c
  misc_feature (406)..(406): n equals a,t,g, or c
ccaccgacggtggacggaccgctrctragcaactnagtggatsccccgggctgcaggaattcggcacgagcctccctgcaactaagtttttcctggggaaaaagcctgcagaccaggaagtgggaggtgtctggtgggacactgccctcaaaaggagcctttctgagtgctggggcttcatctgccagggctgcacctcagcaggcagtgggctcccagagctggctgcagtaacccgcaggctgtgccggcaggatgtggtctttggtttctgtttctgttttagttctgacttgtgccgtggatgtggctgagggcctagggtggggagaagtctccacaggtgggattgaactccccaggcacatggtccttgtggtgctggtggagagagagtcccagaggnttcggacatgctccgttaaaaccttttcctcaaggtgataggtacgtgtcaaggtgacccctgtccgccatccggcaggctggaagaagccggtaagatggacagatcagggagggttggagggtcccgtttgtgaaggagctggggagggggaggcaaggctgagcacagcagcccactgtgatgctctcagtgcagaggccccggggggagacccaggggggcaccccccaaaaccacaccatacagtgagtttcagttcccccactcctgccctttcacttctcctcggctgcctggctgcctcacaggttgtcagcttgagcaagggcccaagcggcctctactcagagaccctggtggtcagaggggagtggggaaggtggacatgggcatcagcacagaccagcacctctggtccatcctgcctggtcatccacaggggagtgccagctcccacccccagccacatactgktctcagcttctgagtggctgggctgtcccagagggccatgctgggcctgagtgctgtccttgggcatatgcagatggtgttgtatccagggggttttcagggaagctttagcactttcatattaaaacaaaaaatgttggaatctccattaaatagtcaagtcttagggatagtagtaaaaacatggctgtacatggctggccaggcacagtggctcacgcctataatcctagcactttgggaggctgaggtgggagggttggccaagagcttgagaccagcctggtcaacatagcaagacccgtctctacttgatttttttttttaaagtacatggcaaagggcattataaagtaagatttgtattagcttgtagctggttactgatgttcataggaagggcctcaaccataataatggtgaaataataaaatgagatgaataaatattagagaggtagaatagtacgtagaaaggtttagcacacattttgtttttctgcacgagtggttgttctctgctttcaaagtgctgaaacgaatgtcctacattgtctgccttccatgaggttctgaccgcccttgagaacagatgtacccactacagggtgaaggtgagaatgtaatttgaagctgaatgagaatggagctggattctaaaattatatcccctctcagattcacaagtgttcacacatttaggcaagaagccctaagtcctaaccctggacatgtggattgtccaggaccatcccagacttttgtggctggattaatcagacctgagcaaactggatgcaaagaggagggggtaggttccgggaaggggccctggtggccagggtgggatgagtgtctggtgctgagcccagagcccaggcccttgcaatgtttttcttggatctgctgggggcagtttaagctaataaaagcctcctcttttattcccagggacacatggaagctgcctcgtgccgaattcgatatcaagcttatcgataccgtcgacctcgag

SEQ ID NO: 4565 - DNA, 725 bp, Homo sapiens
  misc_feature (589)..(589): n equals a,t,g, or c
  misc_feature (630)..(630): n equals a,t,g, or c
  misc_feature (657)..(657): n equals a,t,g, or c
  misc_feature (663)..(663): n equals a,t,g, or c
  misc_feature (675)..(675): n equals a,t,g, or c
  misc_feature (697)..(697): n equals a,t,g, or c
tgtggttgtttaaaagtatgtgggacctctcccctagcactctctctctcttgctcctgctctcaccatgtgacgtgcctgctcttgctttgccttctgccatgagtaaaagcctcctcagcctcctcagaagcagatgctgccatgcttcctggacagcctgcagaactgtgaatcaattaaacctcttttctttataaattacccagtctcaggtatttctttatagcaatgcacgaattgcctagtacacacagagactggcaggagctaccttaggtaacaaacaacagaaaaacaagaaaacagtgggaaaagratatgcacagtaacttttgcacgttgacggacatactttgagaattaacaacccaaatcgagtgaaaagcctttaaagcaaagtatgggcatggagagaactgacctggctgactctgacccttctcaaactctgatctgtgacgtggatgcaggcaatagaaacatggagtgtggctgcctctgaccccaaggagagtgaccctggggtcttaagagaggagttgtggtgtctgggaaagagtctgatcattggaggagacagggctangggtggagtccctgcgtccccatggtcctaattggggttancctggaggaaaaaagatttaaacttcntcctgnacctccaggttncccccatctgttaaaaaggggnggcccataaaaaacccccccaagaaatt

SEQ ID NO: 4566 - DNA, 743 bp, Homo sapiens
  misc_feature (637)..(637): n equals a,t,g, or c
  misc_feature (737)..(737): n equals a,t,g, or c
  misc_feature (740)..(740): n equals a,t,g, or c
  misc_feature (743)..(743): n equals a,t,g, or c
taaaattactccaaggggagaaaaagccaaggtagaggcctggaaggctgtggtggccactgcaacagggcccatgtgaatatcacagaccttccatttctgtgacatagggaaaggtcaggtgaatgctgacttttctggctggctggggcattaccagggcagtgcagcagggcccataggagaaaaaaatggatgggaggacaggaagtcaccaaagagccctgcattctgcaatgatgtggcgctctgaccacgcccagccgcccagcagctccagcgaggaaacaacttccttttgtggtctgaccctggctgkccgccagggctwcaacaagagccttgtgatgtgcacttttgaaatgtgttggtggtgcggaatggcatgtctaactcgtgtttagtgcccttcagcgtttacgtctctttcccacgcccactgacgcagactggctgcatgtggggagctggggtggccggccaacccaatgcctgaccttgtggccggggcacttgagacacgcttccttttcccctaaacctggcctcagtcaggccaagggtacggctccctgaaaggacaaagaaaagagaaaaggaagcctgactgatactagctgccagacaggcattatgntgtttttaatcttcatgacaattctgtggggttttatggcctcccttttacagatggggaaactgaggttcagagaagttaaatctttttctcagggtanacncan

SEQ ID NO: 4567 - DNA, 165 bp, Homo sapiens
tataaacatggagtccggctgcctcatgaccccaatgagagtgaccctggggtcttaagagaggagttgtggtgtctggaaagagtctgatcattggaggagacaggctagggtggagtccctgctccccatgctctaattgtgtttaccctgagaaaaagattt

SEQ ID NO: 4568 - DNA, 750 bp, Homo sapiens
  misc_feature (658)..(658): n equals a,t,g, or c
  misc_feature (748)..(748): n equals a,t,g, or c
gatgcaaccttttcagacagggcttccctgatgaactcagattcctgtgcctttcctgcaggtctctatacctcactacaatggtggaacatcttcatctgacttaccattatctgaagttaccttgcatatttgcttgcttattactttattggttctctcctttactaaattctaagctccaggacagcagggaccttgtttgtttccttaaccagtggcacacagtatgtgcttaacaattgttggttgaataaatgctggataaataaatgcccccacctctattctcactcctaccatcctgtcctgcagacctgtttgtatttccaggacattccacactccttcagacctctgtgcctttgtacatggttccctctgctaggagggcccgttctctacaattggacttggaaagctcctattcatccttcaaaacccagctcaacgccacctcctccagggagctctgctccttccttggctttctcacaacaccttcctcacacgtctactgtgggattagctgttggtaggcctgaatccccaaggacattcaggctaggggctcccatggggcaggggctgggcctgaatcactggtgggttgggggtggagaatagtcccagcacttggcctgagcacccagagtancttgcagagggtgtttgctgagcactgctggacaataaggccttttggggcgtccctgtgaaaaaggggcctcacctgggctaagtggtntc

SEQ ID NO: 4569 - DNA, 712 bp, Homo sapiens
  misc_feature (3)..(3): n equals a,t,g, or c
  misc_feature (6)..(6): n equals a,t,g, or c
gangtngcgtggttaggtcatttccctgcagcctccagccmgtcctgcttctgggcttttgcccctgctgtttcctytgcctggtgtgttcttcctcagatagtcacaaggccagctcctcctcatcacccacactcagcacacctttgccctgtttgttttcttcacacacttctctgctcaggaattttcacatcgcctccctgctcctcactccgccacaagctcctcagggctgggccttccctgcctcactcactgctgcagccttagtgccgggcccagtacctggcacacagctggtggccagaatgcttatcacctgactgattctttctcatctctgatgagagtgggcttcggtgttcagctttttagtaaaccaagtcactagaaggccaatgccatgagggcagggatgctttgtctattttattcgccgcagtctccccagggctagggttgctgagtgcacagtaggctcaatgtgtgtttgtgagagaaaaggaagggagttctcacttggggctgagctggctggagataccagagccaaggatcaaagtctctgagtcccttcagcctcatgaaggggacacacaggcatcccctgtgcatggcgacgggaatgggcccaacatcaggctgaagctcacctgacagcctcgtgccgaattcgatatcaagcttatcgataccgtcgacctcgtag

SEQ ID NO: 4570 - DNA, 281 bp, Homo sapiens
ccctgtgaaaaggggcctcacctggctagtgwctcacccctgcagggtttccccacctcttctctgcccctgtagctgagtgagcttgtaaaaatgtaaacatgatcagctcactgcttaaaaccgtttcagagaatcctcatcacactgggagtaatttccaaatgctgaccatggcccatgaggcctgacctgtggcctctccactctctctatttcactgcagcctccagccagtcctgcttctgggcttttgcccctgctgtttcctctgcctggtg

SEQ ID NO: 4571 - DNA, 1308 bp, Homo sapiens
ccggtttcttgaagcagctggaagtcctggatagttcccacctgaaagtctgtttgcaaaggcaatgcgcactcaggcaccagagggcagaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggrcctastgctacgccgagaattaggcgcccaccgtgttccctccagcgcgcg

SEQ ID NO: 4572 - DNA, 2229 bp, Homo sapiens
  misc_feature (570)..(570): n equals a,t,g, or c
tcgaggcagagtacgctgaacgcgttttcaatcatgagcataaacccggcgcgcgcctgtctggctggtatgattttaatgataactggcgtattggttcgcaactggaacgcctctctcaccgcgttccattacgggcaatgaaaaatggtgttacaggcaacagtgctcaggcttatgttcgctggtatcaaaatgagcggcgtaagtacggtgtctcctgggctttcactgatttttccgacagtaaccagcgtcatgaagtctcacttgagggtcaggaacgcatctggtcttcaccatatttgattgtcgatttcctacccagtctgtattacgaacaaaatacagaacacgataccccatactacaaccctataaaaacgttcgatattgttccggcatttgaggcaagccatttgttatggcgaagctatgaaaatagctgggagcaaatattcagcgcaggtgttggtgcctcctggcaaaaacattatggcacggatgtcgtcacccaactcggctacgggcaacgcattagttggaatgacgtgattgatgctggcgcanastacgctgggaaaaacgaccttatgacggtgacagagaacacaacttatacgttgaattcgatatgacattcagattttaaggataaatatgttacgtaatggaaataaatatctcctgatgctggtgagtataattatgctcaccgcgtgcattagccagtcaagaacatcatttataccgccacaggatcgcgaatctttactcgccgagcaaccgtggccgcataatggttttgtagcgatttcatggcataacgttgaagacgaagctgccgaccagcgttttatgtcagtgcggacatcagcactgcgtgaacaatttgcctggctgcgcgagaacggttatcaaccggtcagtattgctcaaattcgtgaagcacatcgaggaggaaaaccgctaccggaaaaagctgtagtgctgacttttgatgacggctaccagagtttttatacccgcgtcttcccaattcttcaggccttccagtggcctgctgtatgggcccccgtcggcagttgggtcgatacgccagcggataaacaagtaaaatttggcgatgagttggtcgatcgagaatattttgccacgtggcaacaagtgcgagaagttgcgcgttcccggctcgttgagctcgcttctcatacatggaattctcactacggtattcaggctaatgccaccggcagcttattgcctgtatatgtaaatcgtgcatattttactgaccacgcacggtatgaaaccgcagcagaataccgggaaagaattcgtctggatgctgtaaaaatgacggaatacctgcgtacaaaggttgaggtaaatccacacgtttyyrtttggccttatggcgaagcgaatggcatagcgatagaggaattaaaaaaactcggttatgacatgttcttcacccttgaatcaggtttggcaaatgcgtcgcaattggattccattccgcgggtattaatcgccaataatccctcattaaaagagtttgcccagcaaattattaccgtacaggaaaaatcaccacaacggataatgcatatcgatcttgattacgtttatgacgaaaacctccagcaaatggatcgcaatattgatgtgctaattcagcgggtgaaagatatgcaaatatcaaccgtgtatttgcaggcatttgctgatcccgatggtgatgggctggtcaaagaggtctggtttccaaatcgtttgctaccaatgaaagcagatatttttagtcgggttgcctggcaattacgtacccgctcaggtgtaaacatctatgcgtggatgccggtattaagctgggatttagatcccacattaacgcgagtaaaatacttaccaacaggggagaaaaaagcacaaattcatcctgaacaatatcaccgtctctctcctttcgatgacagagtcagagcacaagttggcatgttatatgaagatcttgccggacatgctgcttttgatggcatattgttccacgatgatgctttgctttcagattatgaagatgccagtgcaccggctatcacggcttatcagcaagcaggctttagcgggagtctgagcgaaattcgacaaaacccggagcaatttaaacagtgggcccgctttaaaagtcgtgcgttaactgacttcactttagaacttagtgcg

SEQ ID NO: 4573 - DNA, 2372 bp, Homo sapiens
ggcacgaggctggcctggctgcggctatgtgcgtgtgtgtgtgtgtgcactccagcctggctgtgggtgtgtgcgtgtgcactggtctggctgtgggtgtgtgtgtgtgtgtgcatgtatgcatgtgtgtgccgtgtgctccagcctggctgtggacgtgtgcttgtgtgtgcgcgtgttccggcctggctgtgggtgtgtgtgtgcgtgtgcgtgtgtgtgtgcgtgtgtgtcttggcttcaggggctgtgaggcccctgagagttggggctttgttctctgcacactggaaaccctcccccttctcacagatgcctggccgtggtggggctgcggtggggacccacttggtcttgctgagtgatctgtgacggctcgcggggtggctcaggtatcaggggacagccatgtctgtgaggactccggccccgctcagatgaggcagcccagcccgtcgcccagggtccggcgtgggactgcagtagggatggctctgcctaggtgggccgaggccgtgcggggctttaggtgaggctgggatctaactcagcgcagcttcaggtgggagaaggggcagctgggccctcctggtgactcacatcacgtgagacaacactgtgccctggcctttccagtctttcctgcagctgcgcaactggacggcctccctgctctgctccgcaaccgacctccccgcccgtggcttcagcaaccagatcccgctggtggcgcgggggaactgcaccttctatgagaaagtgaggctggcccagggcagcggagcacgcgggctgctcatcgtcagcagggagaggctggtacggccctgtgcgtcccccgctgggccagctctcaggggcaggaggggggtgcaggaggcagagatggcagcagctggggctggtcttccgacttctcgctaaaggcagatccatctgtggggaggatctgggccgagtgtgaacatggggaggatccgggccgagtgtggccgtggggagggcggagatgagtctgttcttcctgagctgctggctggggctgtggaactttggccgtggtcttgttgggtgcctgtcctagagcagcccccaggggtgacggagaccacaccctctgtggggatgggattggggtggcttctgaggagcaggtggcctggccctgagctggtcctttctgggtaccctggtgcccttgccctctagccggtggggccgtgctcgcctgtgtggtcctagccaggtggcgtgaagcctggccccttttccatcttctgtgaaatggggctgtggttgagagctgggggcctggcagggctggtcacagcacagggacatgccgactgctgggctgggcagggtgcgtggccgcccctgaagtgtagttttggagtaagaaggaatggagttcaggaattccctcacagctctgcctgtggctctgggctgcccccgccagtgttgcaccctgagcctggcaatccacggaggcctggtgcaggggctcagggccgagggcagagcaggccgggcagagccgagagtgccatccctgtccgcacacgctgccgtcgtagttgagagaggccctcagtgggtgcggggctcaaggcggcttagtgggcaggcatgggctgtgacaagtatcactcaggacttgtatgtgcggttcgggagtcccacggccgagggagggattagtggcgcttttaggcctggggccctgttgtcaggtgaagaaggcttgatgcccttcggcctccctgttcttgggtcctcctggggggccggaggctgtcagctgcagagggggagccagcaggcgcccccagcctgacccgagcctcgagtgagggtcccaggagaggaggdgaatgggcacagagctgggggcccacccactgctgcgggtgatgcctgccgctccctcctctgggcccccaggtccccccggggggtaataagacgcatatgatgagattggcattcccgtggccctgctcagctacaaagacatgctggacatcttcacggtaggtctgcgccggctcagacccacgctcccgaggagatggggcagggggcttcgggctggctgccgggggggtttgtgcctcagttggtgggatcagggtggtgggtgaggcgtggcccctgcaggccagggtctccagccccagccccacagcccacagctgcacgtcgacccatggctggcgggtggctctgacgcctgcctccggtgtgttccttgaggcagcgtttcggccgcacggtgagggcggcgctgtatgcgcctaaggagccggtgctggactacaacctcgtgccgaattcgatatcaagcttatcgataccgtcgacctcga

SEQ ID NO: 4574 - DNA, 521 bp, Homo sapiens
  misc_feature (520)..(520): n equals a,t,g, or c
agaaatcaaccctcactaawggsaacaaaagctggagctccaccgcggtggcggccgctctagaactagtgkatcccccgggctgcaggaattcggcacgaggtgggactgtggtctggcacgggcatttctgaagctgtggccacgccattgcagcacgcatcactcctgcacacccagatgcagagctcggtgagaacctcactgtgggcagtgccaggcacagcaggtcccacgtatttgagatgctcaggagccccagggcctggagggagacttttgggcccacatgccccatggttgggaaggtttgggcttaaccagggaataacatcatgcattttgcagctcccttccagctgcagagccagacgttccgatatgaagttggctccgtgcgtaaatcacagcaggtactcaaagcagtggttaccgctctccttattcctgctttctcttccctgagttcaaaagcctgcaaagccagttttgggaaaaaaaaaaaaaawaaaggaaaggng

SEQ ID NO: 4575 - DNA, 570 bp, Homo sapiens
  misc_feature (1)..(1): n equals a,t,g, or c
  misc_feature (505)..(505): n equals a,t,g, or c
nttcaaaggaaaaagaaaacccaccctagtccttgtggcgaggtaaatactgaagaattgactctggcatcctgaaatgtggtgtggcatcgtaacaggggaacaagaatatgggagcaatttaaaccaaacaagactcaaaaatgacagcaatcacggacctgaacacgacgcacaggacgatgactgtggatgtgggttttcccctttgattgctggcaacctcatcaatgctttgcctggagattccagagcacgagtggggtggaacacctgagacccaccattcagacatcctggaaggcctcaggcctcatactgtgtggcttagcgatccccaggccccaggccccaggcccagagctggagcagctcttggagtccagcctgtcctccaccagctgtgaaacactctccagttatgcctctgggaggtggcttctcagtcctcatacccctgcttgtagggtaagaraatacatacsgggaactgacagaatgtggngaccccggagcatgcccagcgcaaccgatattgcttgaattgggcccctgattgcagccatcacc

SEQ ID NO: 4576 - DNA, 338 bp, Homo sapiens
  misc_feature (239)..(239): n equals a,t,g, or c
  misc_feature (246)..(246): n equals a,t,g, or c
  misc_feature (284)..(284): n equals a,t,g, or c
gaataaataacgtgggacgatacaggaacacatgttacagacagaggagaggmaamataggaaggaaaataggaaactcttatgaaagaggccgtgcttgagctgaccctgtgacctggtgaaggcccagcagagcacgtggcattccaggtgcagaagaagcaccaggtggtgacactccaggggacaggatgtgtggctgacatgaggtttccaccaaagccaatgaggaatcgtgntgatggntgcaatcaggacacaattcaagcaatatcggtatgcgntgggcatgctccggggtccccacattcctgtcagttacccaaatatgtattttt

SEQ ID NO: 4577 - DNA, 1168 bp, Homo sapiens
  misc_feature (1163)..(1163): n equals a,t,g, or c
ctggatctatagactcttcttgccctaaagaatggcatgtttgcactccttcccccaacatgtacagatgcctgtcactcttggtgactttgctgggcttctagtccctgcagatgtttaagggagcaatgaatggggagtgtggatgcaaactacggcctccttggcactgtttcagatgggggatttcccttctctaggagaacctgtgctggaaaaggtgtggcacccacactgaaatggggcaagctcttcccagctttgtgggggcccttggaaaacatccactgagatggaggcagtcttcttcctcttcttcctcctgctcctcttgacctggaccagcaagatagcaccaatccttttctcctgatggcagtatctgaatgactttcacagctgaaggccagagaccagcctacagctgggattcaggcttcaaagctttggtgaggatgactccagaaccaggcaggtagtccccctccaggatgccatggcctaaagcatttcactcctcagtcactaggctgtgaactcattgtggctgacacttttattcgctgctatgttttttagcaatgcccggcacacagacctgcttactatgcttttgctgagtgagtgaagggataagtccctttctgcctttttgatactcactttggtgccccttgaggtcacagagacctggatttgacttctggctctgccacacaagagcacggatgctttgggtcagttacttcagctctgagaggctcaattgcctcacctgtgaaatgggttagtgattccaggaatcttaccaggccccatggacagcatgtacataaagagcctagcccttccctctcctccctctccaggggccaggcctgactcccctgaagccatttccttaccattttgatccctaagcctgttatcagatcttctttctgatctaccaccatggctcaaatcttgcccttcatccttgcctttctcaaagacaaaaacacccttcctctgctccactcagagtgtagcggggaggcttatactgcagtggttaagagcatatccctggaattggaaggaacagggtctaagattatgtagatatagcacaaagccttgctcctgctcgtgccgaattcgatatcaagcttatcgatacngtcga

SEQ ID NO: 4578 - DNA, 725 bp, Homo sapiens; identical to SEQ ID NO: 4432
  misc_feature (642)..(642): n equals a,t,g, or c
  misc_feature (694)..(694): n equals a,t,g, or c

SEQ ID NO: 4579 - DNA, 792 bp, Homo sapiens
  misc_feature (781)..(781): n equals a,t,g, or c
  misc_feature (786)..(786): n equals a,t,g, or c
ttttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaccatatatttaatttgctgtctgtgtacataattaatttcctgaaatagcattctaatctagtacatatttcatttggttttccagaatatagagtgaaatttggccttaaaagtctcctcactgagaaggtttgggcttncttgnggctat

SEQ ID NO: 4580 - DNA, 628 bp, Homo sapiens
  misc_feature (542)..(542): n equals a,t,g, or c
  misc_feature (606)..(606): n equals a,t,g, or c
  misc_feature (613)..(613): n equals a,t,g, or c
ggcacgagccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgaagcaagaaatctgcaggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcaggagatcgagaccatcctggctaacatggtgaaaccccntctctactaaaaatacaaaaaaattacccgggcatggtggcgggcgcctgtagtcccagctacncgggagnctgaggcaggagaat

SEQ ID NO: 4581 - DNA, 2583 bp, Homo sapiens
ggcacgagctgaactcccaaagggagtgtgtgtatttcctcccgttctttatcagagcccccaaaataagtaggaatgggcagtggstattcacattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataacatgactgtgaaaatggcaatgttattgtcttcctataattatgaatatttttggatggattattagaatacatgaactcactaatgaaaggcatttgtaataagtcagaaagggacataggattcacatatcagactgttagggggagagtaatttatcagttctttggtctttctatttgtcattcatactatgtgatgaagatgtaagtgcaagggcatttataacactatactgcattcattaagataataggatcatgatttttcattaactcatttgattgatattatctccatgcattttttatttcttttagaaatgtaattatttgttctagcaatcatgctaacctctagtttgtagaaaatcaacactttataaatacataattatgatattatttttcattgtatcactgttctaaaaataccatatgattatagctgccactccatcaggagcaaattcttctgttaaaagctaactgatcaaccttgaccacttttttgacatgtgagatcaaagtgtcaagttggctgaggttttttggaaagctttagaactaataarctgctggtggcactttgtaacgtatgattatctaagctgattttgatgctaaattatcttagtgatctaaggggcagtttagtgaagatggaatcttgtatttaaaatagccttttaaaatttgttttgtgatgatgtattttgacaacttccatctttaggagttatataatcaccttgattttagtttcctgatgtttggactatttataatcaaggacaccaagcaagcataagcatatctatatttctgactggtgtctctttgagaaggatgggaagtagaaaaaaaaaaaagaaagaaaggaaaggaagagaggagagaagaaggcagggatctccactatgtatgttttcactttagaactgttgagcccatgcttaattttaatctagaagtctttaaatggtgagacagtgactgga

SEQ ID NO: 4582 - DNA, 3283 bp, Homo sapiens; identical to SEQ ID NO: 1799

SEQ ID NO: 4583 - DNA, 2988 bp, Homo sapiens; identical to SEQ ID NO: 3958

SEQ ID NO: 4584 - DNA, 622 bp, Homo sapiens; identical to SEQ ID NO: 1801
  misc_feature (96)..(96): n equals a,t,g, or c
  misc_feature (115)..(115): n equals a,t,g, or c
  misc_feature (550)..(550): n equals a,t,g, or c
  misc_feature (605)..(605): n equals a,t,g, or c

SEQ ID NO: 4585 - DNA, 1985 bp, Homo sapiens
ctcgagttttttttttttttttttttttttttttttcaaaaacatatgcaaaaacattttatttataatagatcaacatttttgacatgaaaggtagccactttcaatttctcaggaatgcctagaacccaacagttttcagaaagactacttagttcacaattatttcactgtaggtaaatgaaataatttcagaatgaactttttaaatggctttgcctatggcaaattgttttataaacttgaatgtatggtaagctagctttcccaggaaatgaatgtaatccaactatgttccaaatgtattaaaccagtttatacaacaaatatgagaatcacttatgtgcatcaactgtgctaaaacaagaattctttttatcaaaatattcatttttcaaaaaggcctcacattaacccctcaaaccaagcacccccttcctatgtccagcactcttttctacttcgagttgcatgactgtagagacaactgtcaaattccagtggaactgtacactgacttaagactctatgtaatatacatcaaacacaggaggtcactgactttaagggacgaggtgataactaactagttataattcagccaatgtcttttttagtttagagggaaaaaagtagcccccaagtgtccttaacttttcagtacttctctgtaacacacagaatgaaaaggtactctctaaaattaaaatcattagaaaatatcttaaataaartgttttacataaataagtgttaaatttcagattcaaactatattttcttctgtatctcaatttgggaaaaatctcacaattattaactcttctcagttacatttatttttgagcatttaaatctactatacaccagtttgtaaaattcaccttggttacctctccccatgcctatgtgctgtctttcctcaggtaagtccattatatgcatctaagtgctggggaggtttaaatagcacttaaagaatattcatgagagttctgaaatgaaggtttcgtctttagctattgactgtaggatttgtaattcaaatcatcacagcatcctaaagaaatactgtgtgaatggaatgcacacaattcctacagaacacacaaactgatgtccaaaaggcacagagtaatgctggtggctctttctagtcagttaagaaacaataaaaagtctgcattattctttcataatttaaatacttaagtaatctccactttattattttataacaatgacttcaaatttacattattttaagtaccattgtaatagcttagtgtataatacagatatttgcgaatatcccatccaaaaattaaaaaaaacttcttcactatatatatatttatataaaarttattctgaaagacaagaacatagacaagggacttggtacagaccatcaactcaattttctatcaccacagttgtaactccaaaatcaacaaatatacagcagtaattaaaagcagtgcaaatatctttggaggttaggataaaattataatgcaagaacataaaactgaggaaacaaaaaaggcaagtacttcaagtacaaggaaccagtcggcttgaggtccatcttagtgtttactgggggcttctttcctgcttctacttctttctctgaaatacattggccaacatggcacctgatgttgtcaactggcccattttgttcaaaaacttggtctttgtatcttcactcactaagcttgcagcaattgacattgagccttgaggctcttggacggtcttgttttcaactttttgttcacattcttttatcatggaacttaaaataacctcatgctctggagagagatgttccatgtcagtccgtaaacatctgagaccaggtaaaaagtgattaaccattaaatcctctgaaatgaaacaacaggaaagkgcactgtaggcttcaaaaagatgcgtagcaatgtccagtcttttagaatccacaatctgtaagttcc

SEQ ID NO: 4586 - DNA, 382 bp, Homo sapiens
  misc_feature (3)..(4): n equals a,t,g, or c
gtnncctcagttttatgttcttgcattataattttatcctaacctccaaagatattygcatgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattaaaaaaaaaaaaaaaaaaaaaaaaaaaaaaaaactcgag

SEQ ID NO: 4587 - DNA, 1339 bp, Homo sapiens
  misc_feature (151)..(151): n equals a,t,g, or c
  misc_feature (385)..(385): n equals a,t,g, or c
gcggaacgctgggtcgacccacgcgtccgtattactgcaatgtctgtaactgtttggtgaaggactccatcaactttytggatcacattaatggaaagaaacatcagagaaacctgggcatgtctatgcgtgtggaacgttccaccctggnatcaggtgaagaaacgttttgaggtcaacaagaagaagatggaagagaagcagaaggattatgaattttgaaggaaaggatgaaggagctcagagaagaggaggaaaaggccaaagcgtacaagaaagagaaacagaaggagaagaaaaggagggctgaggaggacttgacatttraggaggacgatgagatggcagctgtgaatgggcttctytggctttggttccaccaagnaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcttgtttcattttcctgaagatttatgtttttgtctaccttgtgagcaggcttttggaagaacctgtttgatgcaaaaaagaaaatgaaaaacaaaacaaaaaatccccaaaaccttattatgggagccktcggtcttagaagctgtttgacatgtataataaatggcattgactgggcctgttttacatttggtgagaacattcaaaaaaaaaaaaaaaaaa

SEQ ID NO: 4588 - DNA, 913 bp, Homo sapiens
ggcacgagttagtgtcctgaaacgcctatgacagtgcctggcccagggttgggcacttactcatgttattcacttattcatatgtgggaatgaacagttcagccagtataaaggacaggtgagtacacaccaaggagatcttcagggagagatcagctggttttcctgtgaagatgtcagcttcatccctccaccgtctccctgtgctcatggctctgttccctttccaggctgctgctgctggttctttgggtctgcagccacctcccacccccatgaagggcaaacccagcattatgttacctcctcagtataaaaggagagagggtctcaaaaaaaaaaaaaaaaaaatccaaaaagttgctcttgtcagctttgggagggcagactccatagttggagatgggcttccaaccaaccaaggagataaatgccagagggagcgaaccatgccaggctcaaagcacatctctccccaaactccccaggtggggaagcaggccagaggctccacaaacccctcagggaggcctggagtccagatgctgtactccagtatctaaacaatcactgaatcttaaagctgacaggttcaaagctcttactttgggccgagcgcagtggcttacgcctgtaatccaggcactttcggagctgaggtgggtggatcacctgaggtcaggagtttgagaccaacctagccaacatggtgaaaacccatctctactaaaaatacaaaaattagctgggcgtgttgacacgtgcctgtaatcccagctactcggtaggctgaggcagaagaatcgcttgaacccaggaggcagaggttgcagtgagctgagatcatgccactgcactccagcgtgggtgacagagtgagactcccgtcttgggaaaaaaaaaaaaaaaaaaa

SEQ ID NO: 4589 - DNA, 2142 bp, Homo sapiens
aattcggcacagagacgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgsgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcarmaaaaaaaaaaaaaaaaaaaaaaaaaaaatgaccctcgagggggggcccgggtacccaattggccctatgaagaggcga

SEQ ID NO: 4590 - DNA, 1096 bp, Homo sapiens
ccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccycacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacactacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcarmwaaaaaaaaaaaaaaaaaaaaaaaaaaaaaaaaaaaagggcggcc

SEQ ID NO: 4591 - DNA, 2152 bp, Homo sapiens
  misc_feature (2080)..(2080): n equals a,t,g, or c
  misc_feature (2145)..(2145): n equals a,t,g, or c
  misc_feature (2149)..(2149): n equals a,t,g, or c
gctaaaggaaatactattttgtatcttgcctttttcaattaataaattgatttttaaaatttcttctcattttcagtatgccactgtctagattctggttacttctgctattcttgccttctcatatctctgtcctctctctcatcagatacccttctgtcaaggaatattgatgcttcagtgtagtcatctatgatcttctcattctgtcttttctttcttggtctttgacactagatactcaacatcccacccctaatttgcctgcctcacccttgatgaaactctgttctatagagctagaagcacagcaagagagatgcttttttcctcgatacttttcagaaatgcattgcacctaatacctgggaraagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagttttyctttttttaatgctcctagttgaatactactggttttctgatagaagtatgaccttctggaagtgtttatactttttaaaaaatttgtgaaaactgataacctatgtttgtttcatgtctaactgattatatcttaaaagcaactactaaggtgtttattagtttgtttgttttttaatcttatttaagcaacagccaactcagtttataaatccagaaacacctggctatgttggatttgcaaacctccccaatcaagttcaccgaaaatcagtgaaaaaaggttttgagttcacactgatggtggtcggtaagaaattaatctatagtctccaacttactaaataaatatctcccctttccaatctctggagtatgataacgtgacctataaagaaagaggaaaatttggcagagtcaaataacttgagaatttgaacaaatatatgtgtattcattagaaaatttttctcaggagcaaaattatttttctgtcactttcttatttatatgtagtgaaagtttactcattgtgtcagctaggctccaaaatggcccccagtgattcttatctcctggtattcacaactttcttgtcccttcctgcattgaatagggttttacctgtgtagccagtaggacattgtggagatgaaagtgttgtcattttctaagactaggtcataaaaggcattatggccccccaccttgcctcttctcaaattactcactctggaggaagccagcccttcctgcattgaatarggttttacctgtgtagccagtargacattgtggagatgaaagtgttgtcatttycyaagactaggtcataaaaggcattatggccccccaccttgcctcttctcaaattactcactctggaggaagccagctgtcatgtcaagagaacactcaagcagscttacagggaagcccaccaagtaaggaaccaaggcctgccaatggctgtgtaagtgacccgtttcagaaatatcytccaggccaggcatggcggctcacacctgtaatcttagcactttgggaggccgaggcaggcaggagttgaagatcaggctgggcaacatggtgaaaccctgtctctacagaaaatatgaaaactagccaggcatggtggcatgtacctgtagttcctctcacctgagtccaggaggttgaggctgcagtaagctgagatcatgccactgcactcaagcctcaagcctgggtgaatgaaaccttgtctcaaaaaaaaaaaaaaaaaaaaaaaagggcggccgctctagaggatccaagcttacgtacgcgtgcatgcgacgtcatagctcttctatagtgtcacctaaattcaattcactggccgtcgttttacaacgtcgtgactgggaaaaccctggcgttacccaacttaatcgccttgcagcacatccccctttcgccagctggcgtaatagcgaanaggcccgcaccgatcgcccttccaacagttgcgcagctgaatggcgaatgggacgcgccctgtancggngca

SEQ ID NO: 4592 - DNA, 616 bp, Homo sapiens
  misc_feature (447)..(447): n equals a,t,g, or c
  misc_feature (578)..(578): n equals a,t,g, or c
  misc_feature (582)..(582): n equals a,t,g, or c
ggctaacagcacctgctgtttgttgagcatttactaactgccaggcactgtgctcagccctttgtgtatatcatcattttaatcttcatggctcatggcatcacattcatttcttttggacatttaccttgttttgtcattatggaaatgcatacctggtttagtgcaggatgtgttcctggaaatgaaagtgctcactgagtcagcactatgcaaggtcatgacacttgagcccctgcagcacagcgttctagtcttcagatgttggcagtcamccttccaggcaaagtcctcaaggccatgtcaggcatccatctttgcctattatactctcaatttctgacaactgcagggcagtccatccaggctgcagcagtttttatgatgygctctctaagtcaccgaagtggtcaccaatgactaaaagcctgctggcctttgctctgngttctgtaaggtttttatctgggaaattggcattttagcatcatgtgccagattcttcctttgctagacaacttttgcaaaccattatgagtggtacccacaatgggtaaaaaccatggaccagaacacanaaanaaatggtgagaagagaagcttcagcataagtgca

SEQ ID NO: 4593 - DNA, 890 bp, Homo sapiens
aggttacttattgctcctacttcatatcatatgtggttctacaacctacattatcttgtctatgtcttttaactagctgtgtgttcttacataagatctgcagaccttggttctcaactgcaaaagcatattgattaaatgattactgtttttacctgcaatactttaatttttggatttgggattaataatgtaaaaaagactaacatatatgtgggattacaaaactgttttgttagccttcaaacaactatgaactgcatcaggagctgtcttatacttattgttctgctattaatacttaatgcactgcctgtaaagagctgattgctacttaaaaactctgcttaaatgaaaaaccaaaacataaaagattaaaccaaacatacttactctcccatagccctggtggacagcaacataaggagggaaatgtttctgttgatctttggcttcaaggattaataccagatttggataccggttagttagataattggtaaggaatcccataaagttgtaaattacataagcttcatagcattctctgcaggtatccacatatattgcaattccgggatatttcaaagctatccactatgaaaaagcacagatgttaaagatagttgcagctaagataaaatgaatcaccactccattcatggtactcacaataagctaatttttatgcttgagatgtcttgtcatatacttacatgggactctctaaaatttatcattatgagggctatcaatctgtgaaatgaatgcttaaaagcaataaacatcttagatattggtaaacaaaaacaagtgtttgaggggtaaataatgaataaagagagaagctaaagtaaaaaaaaaaaaaaaaaaaaaaactcgtagggggg

SEQ ID NO: 4594 - DNA, 1294 bp, Homo sapiens
gatcttgtccaagcagtcggggctacttccaagaatgtcagctcctgttagcaaccagtggagtctggccttgggctctaagttgacctctctatagctccaaatcctaccaatctcagaaaactgtaagaggcacagatgactccaccagctgcagagtgactctgaagagagtcttcacttactgcacaggcaaagaaaggcacaggaatatttcctacctctggcacgaggtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaarttcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcmwcaaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatgttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaatgtgcctcctcttagcatctgtttctgactcccagttatttttaaaataaatgatgaataaaatgcctgccctgaagggttctggaggaaaaaaaaaaaaaaaaaaaaaaaaaaaaactcgta

SEQ ID NO: 4595 - DNA, 2073 bp, Homo sapiens
  misc_feature (14)..(14): n equals a,t,g, or c
  misc_feature (2037)..(2037): n equals a,t,g, or c
  misc_feature (2061)..(2061): n equals a,t,g, or c
  misc_feature (2066)..(2066): n equals a,t,g, or c
ggaggctgtggcgncactgcgcccggcgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggaaaaaaaaaaaaaaaaaactcgnagggggggccgctctaaaaggatnccccnaaggggg

SEQ ID NO: 4596 - DNA, 794 bp, Homo sapiens
  misc_feature (14)..(14): n equals a,t,g, or c
  misc_feature (47)..(47): n equals a,t,g, or c
tttcctaaatccanttaatgggggatggwacctttggtggttttatnccattatgrattcctattttaggtttrgtaaaaagcaatggggaattattggttagaaaacaatgcmcacagtggaatttgagtgagagcatatgcagagtaaatttaatgtatgtctacccataagcggtactgaggaatattagatttcatatgtgaatagcttaggaaaaaatcccttctctaataaagggatgaaatatcatgatcatgatctggattggtatcatcagttatgcatatgcagttagaamcgtcatttcttccgcttttgaattaaagaaaagctgtttttgaagttgagatctcatgcaaattattttagtattctttctaaagcacttttaagcccctgaattgctaattatatccttaccttccatttatgaaattccttctaaacttcagataagagaactcaaatcctctctttttgaaaaataaaatcaatgtaaatataatatataaattgtggaaaatatttcagtcaaactttttgtaaatgttaaaaaagtatctatgaaatctgtgtattaattatgagatgagccttaacgttgtaattttgtcatcaatgatgaaatgaaagggtgttgacatattctttaataggaagttctattataagaaagaaatgtacagtcttgttcacagctaaattctacttgactgtattaattcttggtgttatgaaatttaaacaatgtgatttaaaccttaaaaaaaaaaaaaaaaaagggcggccgc

SEQ ID NO: 4597 - DNA, 1059 bp, Homo sapiens
ggcacgagctggcatgccaaaaactaacagaaacttagttgaaggcaaagagagcaaggagaaagtttaatacttcattacatcaaatcaacactgctccatggtgagagcacagcaactcatttatatatatatatataggctttgttgatgaaaaacracaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattattaaaaaaaaaaaaaaaaaaaaaaa

SEQ ID NO: 4598 - DNA, 1375 bp, Homo sapiens
  misc_feature (18)..(18): n equals a,t,g, or c
ggcgggcggcgcggaagnggcggckgcgcggccggggcagccatgtcgccattgtctgcggcgcgggcggccctgcgggtctacgcggtaggcgccgcggtgatcctggcgcagctgctgcggcgctgccgsgggggcttcctggagccagttytccccccacgacctgaccgtgtcgctatagtgacgggagggacagatggcattggctattctacagcgaacatctggcgagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacstctacaagcacgtgttctgggccacccgtctggcgaagaagcttctcggctggttgcttttcaagacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacataaaaaaaaaaaaaaaaaaaaaaaaaaaaaaaaaaaaaaaaaaaaaaaaaaaaagggcggccgc

SEQ ID NO: 4599 - DNA, 2701 bp, Homo sapiens
  misc_feature (634)..(634): n equals a,t,g, or c
aaggtttaaagataccatgttttcttttattttagagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctrtgggttggaacaacgctaggaacagtgcttgtcattgcactgaaccttcccccagggggagagnawwaacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggaraaawtgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggrtgtgtattacttgccccttaccaatatgcggrtagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatggtagtgcacatgctattcgcatgggaaaattacaagcatct

SEQ ID NO: 4600 - DNA, 1325 bp, Homo sapiens
cggattgtcctgtggaccttattcctgcactttattctgttggagctagacagaaacgtcaaggttacagcaaaaaggaatggcccatcagcggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcarttggtttgggtgggtggagaaccaccacamcaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctggttcttcatcaccacacaattcagatgatgaacaaaaaatgaataattttatagaaaaggcaaagatrtcaaggaagttaagcttacctactgacctaaagcctgatttagatgtaaaggataactcctttagccgatcacggagttcaagtgtacaagcattgacaaagaatcccgagaagcgatctccgctcttcatttctgtgaacgtttactcgaaagacggactcgtccccttccccttgtctgtgggttggaacacgctagggaacagtgcttgtcattgcactgaaaccttcccccagggggagagcaaagacttcttcagccagtaattgtgtctccaagtggtactatattgaggttaaaaggtgcaatcttgaggatgggcattt

SEQ ID NO: 4601 - DNA, 2878 bp, Homo sapiens
  misc_feature (811)..(811): n equals a,t,g, or c
ggtaccggtcccgaattcccgggtcgacccacgcgtccggaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagaknawwaacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggaraaawtgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggrtgtgtattacttgccccttaccaatatgcggrtagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatggtagtgcacatgctattcgcatgggaaaattacaagcatct

SEQ ID NO: 4602 - DNA, 604 bp, Homo sapiens
gcaattttaatatagtcaaacatttattagaagcagaaaagtcattgtaragcacttgaattatatttaaaagtttagcggtctaaactagcaatctaagatgattgtgaaataaaggcatttaaaatcctcctacttgcttatcggaactaccataccagtcaggataagctaagccamgctgcgctaacaaatggcctgcagatcttggtgctttacactactagcaaatgtttcttttacgcttctgctgcctgtccactgggggtcagcagaggccgtcttctctgtcagcatcactctaggatgccggccacccagcagcctctctgtgccactcagcagagggagaagagacctggggagccacgtgctggctcttgttgcttctctttggaagtgacaccgtcactttcacatatgtttcatcagccagagaaagtcagctatggctggctcaatagagccagtaagtctaatcctcctgaagcagaagctctgcagagagaggagccaaatatactgaacataatacagtagacaagagaatgtgtgtgactctgaaaccattaagggagtaaaaaaaaaaaaaaagggcggccgc

SEQ ID NO: 4603 - DNA, 1112 bp, Homo sapiens; identical to SEQ ID NO: 1836

SEQ ID NO: 4604 - DNA, 1549 bp, Homo sapiens
gagtgacactatagaaggtacgcctgcaggtaccggtccggaattcccgggtcgacccacgcgtccgctttctgctgctagataaatgctgatgtttatttttaaaccaggaaacattgatcctgtaacaatgcccgattacaattgctttattacaccccagggctgatggagatgtaatcacttggctaatggatgtgggtgcaggacagatgctcgcttgctggcctgctttcctgcttgcattctgatgagctgcaggagtgcgcctggccttctgcaggtggagctgctgtcagagcttcgtttcactgatacccaaagccatgtctgactgaaataaaacaggttccctttttttttccctttggaaaatgccaactaagggagactaatcagatatcttaacacaatttcatccaggcttagtgctaacaagattgcggggctttttagggtttaagaagatgagaaatgagtgtgcacgtttcacacgttgacttgccggtttttccatgtcatacaaaaaagtcctggctgtttctccgaactggctgcctgcattcccgtctttcttttgtttttaagaaatagactgaattcagctgttaatcctctagtacagtatccatgttaaaatgtttttccattgcatcttttatgtgaattcaaaggtcagaatttattgtctgtgatattgagaccatgtgtacaagaactactttttgcttttcatcattcactccttagcaaacgtttcgtaagtaccctctgtctgtytgctactatatgaggtgctgcgaaattagtgggcgtggctttttatatttttcattcgtgtgtagcctaagtaaggtgactcaagatgatacaccgagagaaaaatgcaaaatatatttggttctcatttctgttgctgtcgtttcctttttaaagacgatttatcaactgctgccatttggaacttcctataagaaactaaaaatgatctatttcagtgttcctttcgcctttcctctgctttctgaataaatggtttcagtaacccatgctgttctctccctattctacgtctttctccctatgttgaaaaaagattcccacagtttctgatgtgtgtgtttatagtcttcaatgtatgttaacatgttaggaactgagtatcttaagagatgtcttagaatgctttagttttcataatttgtcctttatgtatttttcattgtatttgctgttttgacatggaagtaatttaaaaagttggtgcaggaaaggactctttactgttgcacattttggttttctgatatgtaataaattcatggcttggcagctgacatgatgtttcccagagagaaggagatgtatttctgcagggtccagaccaaaagagccatttacagcatgttctcccatgttccattatcagcctgatgaaacctgccctgccaaggcataaacttttgtactagctgtctccatattatgttcaataaattctgtgctctgaatatatttaaaaaaaaaaaaaaaaaaaaaaaaaaaaaaa

SEQ ID NO: 4605 - DNA, 845 bp, Homo sapiens
  misc_feature (42)..(42): n equals a,t,g, or c
  misc_feature (51)..(51): n equals a,t,g, or c
  misc_feature (73)..(73): n equals a,t,g, or c
  misc_feature (97)..(97): n equals a,t,g, or c
gttggcttccaaggattggaaggaaatccgcctccggccttnctaaatggnctggaaggaaaaggaaagcttnccaaaaaagcccaagggaccgggnggaaaatcatcttttggccaaaagaaagcaagaccccgagtggaagcccaaaaccagctaaagcagcaaattcaaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagarcctttgctttttgtattctttaagaaaagcmcaaccataaagtatttta

SEQ ID NO: 4606 - DNA, 337 bp, Homo sapiens
  misc_feature (326)..(326): n equals a,t,g, or c
gtgcccggctgaagacttatttttaatagacttttacaaagtatgcaaaggaccagttattaaaaaagacagtaagtgaccgccctggtaaatagattctaaaattcaatgaataagaaacagatgaatgtcagacttgtcctaaacccttttcctctatattctgtctatgtcatccctaattagccctcacccatgctgctcttcatttcttctacagaaactgaactagacaaccttggctactcgtctatatactcaattgagtaatttaggttcaggatcacaactaatttagattcataatcacagtccagttttctttngtttttttgtg

SEQ ID NO: 4607 - DNA, 1415 bp, Homo sapiens
  misc_feature (64)..(64): n equals a,t,g, or c
  misc_feature (117)..(117): n equals a,t,g, or c
  misc_feature (119)..(119): n equals a,t,g, or c
ggtttttttaaagcaagtaaaccctctccaattgtggtatggctgattatgatcatgacccagnctgtgaggactgaggggcctgaaatgaagccttgggactgtgaatctaaaatncncaaccaattagaatcactagctcctgtgtataatattttcataaatcatactcagtaagcaaaactctcaagcagcaagcatatgcagctagtttaacacattatacacttaaaaattttatatttaccttagagctttaaatctctgtaggtagtttgtccaattatgtcacaccacagaagtaaggttccttcacaaagatcccaagctagcagatctcccagtcacgacgttgtaaaacgacggccagtgcctagcttataatacgactcactatagggagagagctatgacgtcgcatgcacgcgtaagcttgggcccctcgagggatcctctagagcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaagccacgcaaaagagattctccattgcttaaagaacaaatattttaaggaattggaggacctggaggtggacggtcagaaagttgaagttccacagccactgagttggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatsgattttatgtgatgtcccttgcagtggaacggcactatgagaaaraacatgatgtttkgaaaaagtggaccwccggtgccgattcttggcctcgggggcaagattcctatgagtggtgcgattaaatccgtatcagtgcaaagcggttcct

SEQ ID NO: 4608 - DNA, 910 bp, Homo sapiens; identical to SEQ ID NO: 62

SEQ ID NO: 4609 - DNA, 1076 bp, Homo sapiens; identical to SEQ ID NO: 3555
  misc_feature (1029)..(1029): n equals a,t,g, or c
  misc_feature (1037)..(1037): n equals a,t,g, or c
  misc_feature (1040)..(1040): n equals a,t,g, or c

SEQ ID NO: 4610 - DNA, 607 bp, Homo sapiens
gcccagtaaaagctactaggtgacactatagaaggtacgcctgcaggtaccggtccggaattcccgggtcgacccacgcgtccggtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggtgaggtctccgttttgccatctatacaatagagataataaaggctatcccactcttaatg

SEQ ID NO: 4611 - DNA, 1715 bp, Homo sapiens
gggagttggcagcggggttgggtggagctgccatctgcttaagacagccccttgaccgtgctgcccgaagatggatatggctctgactcccacctctcttcccaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggctgtagcgccctttgtggctgccatccctctcctggctctggcaggggccttgccttcgaaactggggggagaactatgaccggcagcgtgccttctcaaggacctgtgctggaggcctgcgctgcctcctgtcggaccgccgcgtgctgctgytgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatcaaaaaaaaaaaaaaaaagggcggccgc

SEQ ID NO: 4612 - DNA, 657 bp, Homo sapiens
gctaacctgtagataactatagatgaaactcacattttccttcccctggttcaccttgacagcattgcagctctggtcagccacagaatgccaggcagtggtggacaccatgatagccgtgtggtcagaagggaagggcacgggagtgagctgggaaccttggctgttggggaagttgcaaagctccagtttcctctaagtgtgcctttatgatccgcactggcsacagcaggctttgtctttccttagaaagactttgtgcctgttctcacttgaccagatatcgtgtacggagcacttgctggcagtaggccaagctctgcacattcatgaattgctttgtctcacaacaccctgagccgtaggtatctttattgaccatattttccagatgaagagacgaaagcccaagagaaccctgttaatgctcggccagatcagaggagacaaaacaagcacccctgccttcatgggttgtgtggatgaatgarggtcggcctagggctgtcccctcgcggtctgtccggtctgtcggtacaggcascagatgggccacttgttcctggaattgcagaagcagataaccaagtktagaaaatgtatgtatccctcttctaccccaacagaagcaccgtctttwtgctttttcttttttcc

SEQ ID NO: 4613 - DNA, 1082 bp, Homo sapiens
  misc_feature (6)..(6): n equals a,t,g, or c
  misc_feature (22)..(22): n equals a,t,g, or c
  misc_feature (30)..(30): n equals a,t,g, or c
  misc_feature (49)..(49): n equals a,t,g, or c
  misc_feature (53)..(53): n equals a,t,g, or c
  misc_feature (120)..(120): n equals a,t,g, or c
  misc_feature (125)..(125): n equals a,t,g, or c
  misc_feature (1027)..(1027): n equals a,t,g, or c
  misc_feature (1060)..(1060): n equals a,t,g, or c
  misc_feature (1067)..(1067): n equals a,t,g, or c
  misc_feature (1070)..(1070): n equals a,t,g, or c
  misc_feature (1079)..(1079): n equals a,t,g, or c
ccccanagggaggaaaaacccntcagttangtagaatgcccaaatcagncctnaagctgaagtctcaagggtgccaacgagtggcctgccaaaagaaagagtgccaggaagggtagggtnccagncagagcctgaggaggaataaccagtgctgaggatagccaaggggctcccggggggtctgagtccttgtcacaccaggaagtgctgtgaccaaagctacaggggcctggctaagacagcttactctattttttcttgaggctttgcagaattctcagaagcactgccagaaaattaaaaacagacacttacagcaaagacctaatggttgaatggttaacaggttcctctggaagtactctttacaaattgttcaaaattataatggctcattatattaggaatctacagaaacagtctggacaaaacaaaaaaacccatcccaagtgcatctggacaggcttcaaggacccccaacagccatcctgcagctctgactccaggagctggacgggaactgcggcctggacctcccagcaagcctctctgcgggcaggcgggccacagcagccgaaggcggagctttgcttccagatgagggtgcacagatcctttaaacttaacggggttaaactgacaccagtcaatctgacaccactgggcagctcaggtgttgtgaagacagagttccacctggggcagtgtcttgttaagatggaaagtccaatgtaaagtgttcattaaatgagaaatacttcctctaaaatagctctgtaaaatcaatatagatcctcaatcaataatttttttgttatttcccacagaaaaaaactacaaaatggtaagctaaaatcagtgtggcatttactaagtaagctttggccttctaaacatcaaaatcaattccatattctgggatataacacatagccacaatggtgtgcaagtaattccaggatgtgagacacacagacaccgtgagtctgtcaatagtgtattctcgagataggttcttcagcaaggntccgttttctcaaatcaaaagagggaagatgtncaaaatnacngacgttggnggt

SEQ ID NO: 4614 - DNA, 690 bp, Homo sapiens
  misc_feature (36)..(36): n equals a,t,g, or c
  misc_feature (604)..(604): n equals a,t,g, or c
  misc_feature (630)..(630): n equals a,t,g, or c
ggcgaacaatcgcttcatctccctttggttagggcnccaccaaccaagtgtagaaaatgtatgtatccctcttctaccytwcataagcaccgtctttttgctttttctttttttttttagttacagatatgataggtaggtttttttctatggtgtaagcatttctgctgttggattttgtttgctgtttgaagacctgcctaactcgtctcagtaggctgtataaatcgtttaatgaagattggcccttttctgaagtgagaaaaaggatggttgctgaagaacctatctcgagaatacactattgacagactcacggtgtctgtgtgtctcacatcctggaattacttgcacaccattgtggctatgtgttatatcccagaatatggaattgattttgatgtttagaaggccaaagcttacttagtaaatgccacactgattttagcttaccattttgtagtttttttctgtgggaaataacaaaaaaattattgattgaggatctatattgattttacagagctattttagaggaagtattyctcatttaatgaacactttacattggactttccatcttaacaagacactgscccaggtnggaactctgtcttcacaacacctganctgccccagtggtgtcaagattgactggtgtcagtttaaccccgttaaagtttaaaagga

SEQ ID NO: 4615 - DNA, 1618 bp, Homo sapiens
  misc_feature (2)..(2): n equals a,t,g, or c
  misc_feature (92)..(92): n equals a,t,g, or c
  misc_feature (119)..(119): n equals a,t,g, or c
  misc_feature (151)..(151): n equals a,t,g, or c
  misc_feature (180)..(180): n equals a,t,g, or c
  misc_feature (963)..(963): n equals a,t,g, or c
  misc_feature (972)..(972): n equals a,t,g, or c
  misc_feature (975)..(975): n equals a,t,g, or c
gnttgggatcccaagagttttaaaattgttaggaaaggtcccatggttcctggtccccttttggccaaagcccatttttctttaatcctgtncaaaaggggaccaatgtcttgcacccncagggtttgggaagattttcagtaaagagtgnatgtgaagagtgtttcgtaacccataaancagtttattgtcattgatgattctcagctttgcatgacctragggmcaccagaccmcttgctctaggagcccatattctgggttctttgtcctaaactactttttgggccttttcctaaaaatmcccattctaagagtcaaggtaagagtgttcctaatttggtgcatggatgagagttcatgttagttttcattgaggctggaagttaaacctgagccattttcctgtccagctgcactttgccacaggctgggcacactggctcatacctgtaatcctagcactttgggagactgaggaggattacttaagaccacgtgttcaagaccagcctaggagtatagtgaggtgccatctcttttaatttttaaaaaatagtcctagtgactcttaccaggccagtcaccatctccaggagcccccctgtgggagtatgttcagtgtctgccctttgtgaagtggggccttttgtcccgccacctacccccagggcacttaaggcctgggtgtgtttctgccggcagggacttgaaggtgtctggcagtgaaggaaggagaggatgaagggaggctggagagggagtggcgagcggccagaggcaggcggggccgtgggaagggaaagcagcacaggcaagctgagtgcacattggtgatgagatacagagatccatgattgaacttctagtgtatcttagcccactggggctgccatgacaaaacaccatagagtgtggctcatcaacagcaggagtctgttgctcacagctctggaggctggnggtccaggntcnaggcactggcagattgcatgtctggtggggccccgcttcctggtccatagccagcaccttctcactgcatccttatgtggtggaagaggcaggggagctctctggggtctcttttgtaaccccattcttgaggcttgtccactctcatgacctaatcacctcccagaggccctgcctcctaacaccattaccgtagagtgagagcttcagcctatgaattttggggggacatgaacattcaagactaatattctttcagtattccagttactgaatggtgtgtagtattcagtggagaaggtagctgaaattaaggggttaaaattgtaataatggccggttgcggtgctcacgcctgtaatcccggcactttgggaggctgaggccagtggatcacaaggtcaggagttcgagatcagcctgaccaacatggtgaaaccccgtctctactaaaaatacaaaaaattagctgggcgtggtggcacacgcctgtaatcccagctactcaagaggctgaggcaggagaatcgcttgaacctgggaggcagaggctgcactgctgagctaagatcgtgccactgcactccagcctgggcgacagagcgagactccatctcaaaaaaaaaaaaaaaagggcggccgc

SEQ ID NO: 4616 - DNA, 604 bp, Homo sapiens
  misc_feature (579)..(579): n equals a,t,g, or c
  misc_feature (595)..(595): n equals a,t,g, or c
  misc_feature (603)..(603): n equals a,t,g, or c
ggagaataacaatagtaaataataaagtcatactgaaatgggatgctaaattacagcttgaagcagaggactcaaatttgtgcctttaacaaatctcatctagtccctgatcaaacaagcttatggcatgtcacagacatcaaaggtccctttctaaaaatcaggaatttaaatctgtgaacgtcagtggtctatatatatttttttcttataatgaagtctttaattaaaacctactttttactatggactttaaaaaaacttcttcctctttccacactcattccaattatgctctctcctttggatatattcttttctgataatccccacatcgattgcagtggtcatcactttgtgccttacctcttgattgggctagacacggaccctcagtttacctgcctttatctgctgatcctgactttattggtatttgtcttctctctcaccctgctgtcccctccttcaccaggatgaaaatgagcaggaaggcccaaactttaggatctaggatctggaacttctctttattactytattggattgacttctctagatcaagctttttaaaaaccntgcctctcaatccacntaagaatng

SEQ ID NO: 4617 - DNA, 1034 bp, Homo sapiens
ggcacgaggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaaaaaaaaaaaaaaa

SEQ ID NO: 4618 - DNA, 853 bp, Homo sapiens
  misc_feature (820)..(820): n equals a,t,g, or c
  misc_feature (832)..(832): n equals a,t,g, or c
gctgcagctccggtggaaataataagatataaaccacgaggttgttatttgcatagaaatagcatggagccccaggcagcaagggagaaggacacagggatgatttgtctaaaattttaatgaaaacttttgctgaggcagagatttttaaaaactttctttctccctgcttttccccttccttcccctaccccccaaaccccatcattgattttacttaacatggttcagtttgaagagaaaaggttgacactccacatatcatactcccataatgcagcaacctgtaaattgtttcttcctttaatagatatgaagctgaagagacatgcattttcaacttaatacattgcatgtgtgcgcckggctttatggctatactccatcttgggcatacacatgatgttgcctgtcattagcctgtttttaattagtttacaccttcctatcttttgcttccaaagactcttactttttaaaggatttctttttatagccaacagtagtaaccttcatataaaataaatattttctggtgttttcctgtttttttacttttggtggtttttctgtatacttacatgttttattcatggacgccatcctttgccactgtgtcttttattccaaaaccaggaagtgcttcccaccttcgtatttttatccttttccccctgtgaactcaccatttgtgtatcttctttccatgtctgtcttgctttgttgcctgcagttatttgtaaaatattcaaaatattacccaaattgagrtgagttgtagkatctggattywattgaktgttactaagcacatttgacnttacaactaaangcagtacgctggtgattagaa

SEQ ID NO: 4619 - DNA, 441 bp, Homo sapiens
  misc_feature (11)..(11): n equals a,t,g, or c
tttggccaacnggaacatttggccagaagatggatccatatttaccttcccctccttcccaaccaactcctccctctcagtttcctttttactttatttttttctccctttccctggtaaaaagtattagtatgtttaacatagtgttaggtggcagataggctgggaagagctagtattgtaaaggaacactgatgtgtactggagcctactagctctcaatccattgccccagacttggggagagagagcacattctctatccagagaaataagaatatgcagtttatggttgtcctgtggacattaactgactgtgaaggtaaggtatatccaaaggcagtgatatgcaggtgatagattcaccaggagatgatatgtgacttttcttgtattttaaagctctgcttcttttttaraaaaaaaaaaaaaaaactcgag

SEQ ID NO: 4620 - DNA, 1333 bp, Homo sapiens
  misc_feature (1140)..(1140): n equals a,t,g, or c
  misc_feature (1196)..(1196): n equals a,t,g, or c
  misc_feature (1210)..(1210): n equals a,t,g, or c
  misc_feature (1246)..(1246): n equals a,t,g, or c
  misc_feature (1285)..(1285): n equals a,t,g, or c
  misc_feature (1287)..(1287): n equals a,t,g, or c
  misc_feature (1306)..(1306): n equals a,t,g, or c
cagggcaggaaagtgacatggctaggtggctcttaccctgccttccgcctctccacagtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcaggttggcaaggggagggcgaaggaagcagagaacaggggagtcggcctctgcatcctcaataacaagatcagatactcccactcaccaggtgcttactgtggcaggtgcagggctgagcatgggacacacattatttcctttaatcctgtaagggagataccagctccattctacagatggcaaaactgaaacccagagaggtttagaaacttgttgaaggtcacatatgtcctaagtggaaaggctgtctagctccaaagaccatgcacttgacccccacaccagctagcttagaaggtccaaacactatttggcactaccagatccttccacttagcaaagacagcagatcctggtgccagggcacagggctcacctggatgtggggaggagtggctctggcacctgccaatactttgggtcctacaggccctgcttgaggtctttggcctctttggtctttggtctttttctcctggaacagaagttgaaatggggaggagacctgggcagtgctcttggaaattaacccttcacttctctgcccctgtgtttcagttcaaatcagccttctcatctgcggaaaccacagaattgagtggcaaatgtgtggtggctttggcaacaggtgaagtttgggggcagctggtaataagaaagggcatggaggatgtgtagtgcggtagcatccagtgcccagatctggctcgggagttggttgaggaacatgtcattcttttctctgctttttgaggcccaaggggtcagcattcccagtttgaggtctgagagccttaggagcaggctcctgggaagtgtggaaaaagtccaaggcccaagagaaagagctctccagggatcctgagctccagggctctcarcagtgccctgtccaactgggcccaaaccttgtcactctgcatactcccctgcyngccatmwccacctgtmtgtgtgcccgcagatcccaatatcctgarcctgartgggnaaggtgctggcatnctggggaccttgcttcgacgctatgggccttcgggnatgtgggaccgggccgccccggtccaagaactatttggncntttgaacctctgggtcctntttaacaacgtggttcccgggccctgg

SEQ ID NO: 4621 - DNA, 943 bp, Homo sapiens
  misc_feature (25)..(25): n equals a,t,g, or c
  misc_feature (111)..(111): n equals a,t,g, or c
  misc_feature (832)..(832): n equals a,t,g, or c
  misc_feature (842)..(842): n equals a,t,g, or c
  misc_feature (866)..(866): n equals a,t,g, or c
  misc_feature (896)..(896): n equals a,t,g, or c
  misc_feature (921)..(921): n equals a,t,g, or c
gccactgaacctttggggttccctncttccgccttttccacagtgtgacaagctggctgctgactgtcccacgagctgcggcgccatggggtcagctgtgtgtctctgtgnccggggattgtgcagacagaactgctgaaggagcatatggcaaaggaggaggtcctgcaggatccaggtgcttactgtggcaggtgcagggctgagcatgggacacacattatttcctttaatcctggatgtggggaggagtggctctggcacctgccaatactttgggtcctacaggccctgcttgaggtctttggcctctttggtctttggtctttttctcctggaacagaagttgaaatggggaggagacctgggcagtgctcttggaaattaacccttcacttctctgcccctgtgtttcagttcaaatcagccttctcatctgcggaaaccacagaattgagtggcaaatgtgtggtggctttggcaacaggtgaagtttgggggcagctggtaataagaaagggcatggaggatgtgtagtgcggtagcatccagtgcccagatctggctcgggagttggttgaggaacatgtcattcttttctctgctttttgaggcccaaggggtcagcattcccagtttgaggtctgagagccttaggagcaggctcctgggaagtgtggaaaaagtccaaggcccaagagaaagagctctccagggatcctgagctycagggctctcagcagtgcctgtccaactggcccaaaccttgkcactytgcatactyccctgcctgscatctccacctgtctgtgtgcccgcagaatccaatatnctgacctgantggtaaaggtgcttgccatcctgngacccttgcttcaacgcttatgggccttcngggaaggtggaccggccgccccgtncaagaactattttggcctttga

SEQ ID NO: 4622 - DNA, 846 bp, Homo sapiens
ggggcaaagctgcggtgaggacccagtggcataggagctgaggaggtaaaagacagtgatgttacctatagctcaggaggtacaatccccagtggkcaramtgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaaaaaaaaaaaaaaaaaaaaaaaaaaaaaaaaaaaaaaaaaaaactcga

SEQ ID NO: 4623 - DNA, 2271 bp, Homo sapiens
aattcggcacgagagaaaacccacaacaaaacttgcgtcgcggagagcgcccagcttgacttgaatggaaggagcccgagcccgcggagcagctgwagactgggggagcgcgttcggcctgtggggcgccgctcggcgccggcgcacaggttccatcagccctggcgcccaggcgcatctgactcggcaccccctgcaggcaccatggcccagagccgggtgctgctgctcctgctgctgctgccgccacagctgcacctgggacctgtgcttgccgtgarggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggttattgacctgcgtgagttcccgggggacctgcctgagcacaccaaccacctatctctgcagaacaaccagctggaaaagatctaccctgaggagctctcccggctgcaccggctggagacactgaacctgcaaaacaaccgctgacttcccgagggctcccagagaaggcgtttgagcatctgaccaacctcaattacctgtacttggccaataacaagctgaccttggaccccgcttcctgcaaacgccctgatcagtgtggactttgctgccacctgggctgcctcgaaatgtccatgtgctgaatgtcaagcgcaatgarctkgctgccttggcacgaggggcgctggttgactggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggatgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctaaaaaaaaaaaaaaaaaagggcggccgct

SEQ ID NO: 4624 - DNA, 407 bp, Homo sapiens
  misc_feature (140)..(141): n equals a,t,g, or c
  misc_feature (335)..(335): n equals a,t,g, or c
  misc_feature (373)..(373): n equals a,t,g, or c
aattcggcacgagagaaaacccacaacaaaacttgcgtcgcggagagcgcccagcttgacttgaatggaaggagcccgagcccgcggagcagctgwagactgggggagcgcgttcggcctgtggggcgccgctcgggcgnnggcgcacaggttccatcagccctggcgcccaggcatctgactcggcaccccctgcaggcaccatggcccagagccgggtgctgctgctcctgctgctgctgccgccacagcttgcacctgggacctgtgcttgccgtgaaggccccaggatttggccgaatggcggccacagcctgagccccgaagagaacganttgcggaagaagagccggttgttgttaattgaagcctngaagaagcccggggcttgggcccaagccgcggtt

SEQ ID NO: 4625 - DNA, 1046 bp, Homo sapiens
  misc_feature (1034)..(1034): n equals a,t,g, or c
  misc_feature (1041)..(1041): n equals a,t,g, or c
aaaagatattacagccaattatcatttaatgaagatacatttttgcttgctgtcgggagaataaagcagggaacctttatgtagtgaacaccatcgggatgatcgggtactggtaattaaattcctggtggattgtgctgtaattagtttaaaatcggagtgtcatgcagccccgcctcttgtttgctgttgtggtaataatccgttccttccttgaggacagcaccgtgttagagtggagcggcaaccaggtctagccctgtctcaaaacatctaaataagtgatgcgctgtcacccagctaacaggaggaaataatacattttcatcaacaaccttgtacttgagagttcaaaaacgtcaccccttttccaattgcwagatactgkggctacmcctgaagcttatgggaagcmaaagwtagataggttttagatttaaatttttttttaaagaagcatgactgttagaactgagatgcagtcccataatggtaccgcmtgctgtttagtgcatatttagtagatggcattattatctctcaacatttctcccytcttgcgtggttaagaagataaattccagcatgttctgaaccgatattcctgtagggaaggagaggatttccctgaactctccaccccgctgccctggtgagagcttgctgccatcccaggggtggatccactttgaagttttaatgtgatgtgaagccagcagatgttaaggacataggtgggactgttgaagcatcctgcatgaatttttcatggccagctcccactgctcaggtgcacaccagaaaaagaagggtttgggcctgcctgagagtagatgtgtcttccgaggtcagacccgggaaagctttatgaacctgtcaacctatttttggcttttgctttgaagattttacgttgagttaacctttgtggaacagaacttctgaactgaattactatgtgaataagagtttcttcctctaaaaaaaaaaaaaaaaaaaaaactcgagggggggcccgtacccaatcgcctgtnatgatcnaatac

SEQ ID NO: 4626 - DNA, 2634 bp, Homo sapiens
gccttaacagatcagggatcaggaacatgactgcccttgctcatctgctggccctccacatttgcccagtccctgggtctctctgcctccgtttcctccctgtttgatgaggataatcacgaagcacatcaggactgttgggttagatgaagtcatgcaggtaaagctgctgtgcactgcagacatgtcagcatggctggtcagtctctgtgcttggctgagcctgctcagagccacagtgacctcccaggtgtcctcctcccctgctcccgtcgtggcatctgggactctgtccccctgccaccctccagggtctcctgctgcttctgcctgtttgctctctcctcagtctccctgcagaagagcttccaagtggaggagtcacatgactggggtggcaccgtccaacagaggcagtagctgcgagtccagtgggtctcagggcaagccaagtcaaagggctggggcctaagacaacagggataggagtcaatgcacatctgtgagatgctggggaagcagcatcaacatgacttggggaccccttgggcccacagctctctgcatggaaagggaggaaggagccaagctggtgagcacccagccagtgttttgtggacatgaacagttctggttctggagagggatcttcgttgagcttgatagagacatgtgctgtcggactgtagatgtcatgagtttctgaggaaaggtcagcatgacagaatcactaggagcagggtaagctgtgtggcatcagcgcttgcatcctgcagggagttacctaccagggctgggccgggactggccagaaccttgacagatgaagtttgaccagaccaagtgagtcctcatggtctgatacgtaagccagatgtgagttaccaatttgcaccgggggctgtgctcccccagtggctggcctgccctccaccatataacccactggcagcacctcaccgtagatgggacctggctgggtgcccgttctagtcttcagcccagctccccccttggctgggcccagcagctggcctctcagggccctatgcgcccctcggatgggggtctttgaggggagcttcatgtgcttgtcttaagtcgatgggtctggacaagggtcttagatgtggcacagtcagccagccggtctgtgtgtgcgtccctcctcagagggggccccagcttctgcacggtccgctcacgtgcccttccgcagcctgggcactgcaggcagggggagggggtgccacccaggcaaggccagctcggcagtctgaaggaacggctgggcagccacctctgaccacacgtgtgtccgtgccggcgtggttatctgggctgcctacacagttcacgctaacatcgtagctcacgctaacatcgtggctgttgatgccacgtgttgtgaggcctttgtcagctcttctcctgtattccagggcaactccaacaacattgccaccgtggacatctccgcaggcttcgtgggcttagacacctacgtggaaaccccagccgtgctcctgacagcgtttgggacgtacgcagggcctgtgctgtgggccagccacttagtgcacttcctgagctcagaaacacgcaggtgcctgtggacgcttgacacgcccactttggggcagtctgtggacagacccccgtaatttacagtcaccaatgagcttgtcatcacagcagaaagctgaggctctgcgggcggaagccaccaacagaccagcttgggagacacccactgtggcggcgctgtgtggagacgtccttccagacttcgattctgcataaaaacaaacgtctgccacgagacccctgctcggcgtccgcctgtctcagcagctgccctgggacgtctttctctgacttggttttgaggccagccgcgtgctcacactgggcttacagaaacaggagacgccgtcctcggccgtctggggtgggctgtcagcacgtcgtgtggtcaggtgtcaggacaagcgggcgtgagcgcgtggaggtgcatctgcctctgccctggagaacggatgtgctacagctgtgcgcggcgtgatcaagcacctgttgggtggacggcacacctcccagtggccagctggagacggagggctggaagtacttgcccggctcctctctctgtaggtttggtcttcggccttgcagctgccctggtgcttgcagattgcggtttgatggaccaggcacttttcatctcttacacagccagtggttcagcactgagtcatgcttgcttctgctacgcactgatttgttctattccagtttccacgtacatcgttttggtgacatctctgcgttatcatttatttatatggagtgtattttctccaaaacttctctacgagggaatgcacctgcttattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatataaaaaaaaaaaaaaaaaaa

SEQ ID NO: 4627 - DNA, 540 bp, Homo sapiens
  misc_feature (480)..(480): n equals a,t,g, or c
  misc_feature (494)..(494): n equals a,t,g, or c
  misc_feature (524)..(524): n equals a,t,g, or c
  misc_feature (527)..(527): n equals a,t,g, or c
gaacatcccgtctccagaggtcaagagattattagcccaaagtgtagctacttgcagatagagcaggggcttttgtcctctgcttcccaactcttgccctatctttctattgtaccactccaaatatttcttatcacaatgttgctgttagtagtaacactagtaaatctgagtatttataagctcataaagcttgttacagccttaagcaaaaagcttggggccaagggcgttttaaaaaatgcacactttatgaggtgcaactgcggagaaatgaggacgcgttcttaagctttggtattcacatggtggtggtgctggtagaggctgttacatttcttccagtgaagctgttcttgcagccgccttggaattcacttcagggccagtttatgagccaccccaagtaatctgcttgggagtctgagcatcataccttggtatttgaccaaaatatatgtaacaaatttaccctttttnaccattgttaaggnttacaattcagtggtattttgcagtgttgnatnaccgtcatcactg

SEQ ID NO: 4628 - DNA, 1326 bp, Homo sapiens
  misc_feature (1305)..(1305): n equals a,t,g, or c
gcgcgggaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagartcacattttcttgcttagtcatgtgtccctccttgagttgccccctccttgtgggtttacactacattttggagtcattgtctaatgctgacaagcacaccctctcccattatttgtgcactacagatctcctsctgatcagtcacctttgttgctgctgtgtagacagagccaggcctcacctgtttgtttaggccaagatgccatggacatgcagcgttagtgatcccactagctgygacagccaggcccagaaaatgcctggcgtgagagccagcagacagccaggccrgggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaaaaaaaaaaaaaaaaaaattnctgcggtccgcaagggaattc

SEQ ID NO: 4629 - DNA, 841 bp, Homo sapiens
  misc_feature (40)..(40): n equals a,t,g, or c
  misc_feature (73)..(73): n equals a,t,g, or c
  misc_feature (94)..(94): n equals a,t,g, or c
ccctggggggccccccaatccagatgccaggaggaatggnggggataccaggaataatggtaccaaggaaaangggacctaaaaggattggggnccgttttggatggctcggatggaatggctgggggaattccagagggaatggccttcaccttataccttgggatttggctctcttccccatttcctgattgttgtatagctttcrattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaaataaatttattgcaaaccacaaaaaaaaaaaaaaaaaaactcgta

SEQ ID NO: 4630 - DNA, 580 bp, Homo sapiens
  misc_feature (14)..(14): n equals a,t,g, or c
cagagtatttgaanagtagccaaccacattcacataactttattatagtatgttatcattgttctattacattattattaatctcttgctatgcttaatttatacattatactttatcataggtatatatatatggaaaaaacagtgtataaaggtttggtactgtttgaggtttcaggagttcactgggggccttggaatgtatctcccgaagataagggggaactactgtaagcaaaatcgaaagctatacaacaatcagaaatgggaagagagcaaatccaagtataagtgaagacattcctctgaattcccagcattcatcgagcatcaaaaacgaccaatcttttagtccttttcttgtacattattctgtatccacattctctgcatctgattggatccctagattttatttcattttctgtgtgacactctccacagatatatatcattggttgctgctttggaggttgaacgtccttctgggtgtccattgttagcccctacacagcacggaaaaactcactccgcgtttccaaatacaacccggctagtccaggtgtcctcgtgccgaaat

SEQ ID NO: 4631 - DNA, 543 bp, Homo sapiens; identical to SEQ ID NO: 1863
  misc_feature (463)..(463): n equals a,t,g, or c
  misc_feature (483)..(483): n equals a,t,g, or c
  misc_feature (520)..(520): n equals a,t,g, or c
  misc_feature (528)..(529): n equals a,t,g, or c

SEQ ID NO: 4632 - DNA, 522 bp, Homo sapiens
ttgtccccagagacccaytgtgtgccccytggagctcctcctagagcagagtctgctgctgtctgttctgcagagggtagcctgaggcccaaggaggttgtcagggacacacagcagggggagcagcccagatccctgctcatgcgtggtttgggcctctgctaacagctgggccacatgcgtgtatctagagcctgggtcccctctgtcctcatttccctgtgcatattcagggacatgcctcgtcagggtttggcaagaaaatggggcatttaataatctccccagtttcattccttggtccttactccatgccaggacttgtgcacatctttttggagccctgtctcacttgattgacagccggccaggcgcggtgctcacgcctgtaatcccagcactttgggaggacgaggcaggcggatcatgaggtcaggagatggagaccatcctggytaacacggtgaaaccccgtctctactaaaagtacaaaaaaaaaaaaaaaaaaaaaaaaaaactcga

SEQ ID NO: 4633 - DNA, 2223 bp, Homo sapiens
  misc_feature (338)..(338): n equals a,t,g, or c
  misc_feature (2206)..(2206): n equals a,t,g, or c
  misc_feature (2209)..(2209): n equals a,t,g, or c
cctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagncggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactcsacggcgcgcaacgtgacctggaagctgggcagccgactgtacggacccagctcagtgagcttcgctgatgacttcgtgcgcacagcaagcagcactacaactgcgagcactccaagatcaacttccgcgacaagcgcacgcgctgcagtccatcaacgagtgggccgcgcagaccaccgacggcaagctgcccgaggtcaccaaggacgtggagcgcacggacggcgccctgytagtcaacgccatgttcttcaagccacactgggatgagaaattccaccacaagatggtggacaaccgtggcttcatggtgactcggtcctatacygtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttrtcacgcatgtcaggcaagaaggacctgtacctggccagcgtgttccacgccaccgcctttgagttggacacagatggcaacccctttgaccaggacatctacgggcgcgaggagctgcgcascccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaarcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacaaaaaaaaaaaaaaaaaaaaaamwmggggsgggccgctcctagagggatccctccganggngcccaatcgaaaat

SEQ ID NO: 4634 - DNA, 697 bp, Homo sapiens
  misc_feature (2)..(2): n equals a,t,g, or c
  misc_feature (12)..(12): n equals a,t,g, or c
  misc_feature (143)..(143): n equals a,t,g, or c
  misc_feature (149)..(149): n equals a,t,g, or c
  misc_feature (646)..(646): n equals a,t,g, or c
  misc_feature (685)..(685): n equals a,t,g, or c
  misc_feature (689)..(689): n equals a,t,g, or c
cnctgtacattnctgtagctcctttcagccatgctccctggagagaatgaaattgttgcctggattaatgaaagcgtctgtgttgccaggtcagggctggctttggatgtagatggtgccccagccctttcccctcaactttncagttngaaaatttcaaacttagaggaaaatggaagaacagtagaatgaacacccatccaccccggacttagatttagcaatcgttaacattggctatatttgctttctctttctctatgtctaaacatagacacacacatatacagctctctcttgttctctgattcagctaatcattaaaagtaagttacagtcatcctgtcacatgactaaaacctttcagcacgtatctcctaaaaaccaagatattctacaaaaccacagtaccattagcacgcccacgaaatttaacctgataaaataattcaggccaggcgaggtagctcacgcctgtgattccagcactttgggaggcagaggcagacggatcactcctgaggccaggagtttgagaccaggctggccaacatggcaaaaccccatgtctactaaaaatatttaaaaaaaactagctggttgtggtggcacacacctgtaatcccagctactcagggaagctgangcacgagaattatttgaacctgggaagcggaagttgcantganccaaaatc

SEQ ID NO: 4635 - DNA, 817 bp, Homo sapiens
  misc_feature (12)..(12): n equals a,t,g, or c
  misc_feature (789)..(789): n equals a,t,g, or c
  misc_feature (807)..(807): n equals a,t,g, or c
  misc_feature (812)..(812): n equals a,t,g, or c
ttttaaattttntttcctattttttaaggctgttaatatttaatttgctctttatgaggtacaatttacaatatgacacagttatttcctgttttgtcaaatacacaaatgcatggaaattctttaaaaattaaaagaaataagtttaactgaaaaagtattaatatataagcatgactcattaaaagctgatagtccaatctattttacaataccttccagataacagtgtgccaggttgaatgctgtaataaagttccatgcgcaccaattgtagaaaacagagtttgccctgcactcttcctgacagcaggacggggatccacacatagttcacccaattttgcataaagacataaccacaagcaatcaaatggcggtgcagggtggaatggccgatttaaaacaactcctttytcttctgcctgcttttgctgtgctgcctcttccttatttagttctttttcaatagtttcccctctttggaaaaaataatctgaaatattccacaataaacctattgaagttaaactaatattgagttcttggttatggaggccaaagctacctgcaacatctacaactatttgcaggcaagtacaaggcattgttggtagaaaatctgtcacaaccaactgaagacactggaatgcagttcgtatcaaggattctccttgatcatttctgattgctcccatgactccaagcactaatggccatccaggcccaagactgtctccctgactctgcagaatctgcaacacgcattctaactgcttgagtcgaagntcyggatgatttwtattngaganccggc

SEQ ID NO: 4636 - DNA, 625 bp, Homo sapiens
  misc_feature (606)..(606): n equals a,t,g, or c
  misc_feature (612)..(612): n equals a,t,g, or c
  misc_feature (625)..(625): n equals a,t,g, or c
ccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatkcagttggccaccggccaggcgggcatcattctggtgtctgtkaamccagcctaccargctatggaatggagtaygtcctcaaaaaagtgggcttcaarggcccttgtkgtccccaagcaatttaagaccaagcataatacaacgttcttgaaacagatctgnccagantggagaatgccan

SEQ ID NO: 4637 - DNA, 2074 bp, Homo sapiens
  misc_feature (18)..(18): n equals a,t,g, or c
  misc_feature (200)..(200): n equals a,t,g, or c
gctcgggccgggacgcanggcaaagcgagccatggctgkctacgtcgggatgctgcgcctggggakgctgtgcgccgggagctcgggggtgctgggggcccgggccgccctmtctmggagttggcaggaagccaggttgcagggtgtccgcttcctcagttccagagaggtgggatcgcatggtctccacgcccatcggnaggcctcagctacgttmaggggtgcaccaaaaagcatcttaacagcaagaytgtgggccagtgcctggrgaccacagcacagagggtcccagaacgagaggccttggtcgtcctccatgaagacgtcaggttgacctttgcccaactcaaggaggaggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctstctgtccttgtgatttggcataaagagcttctgttttctttggcaaaaaaaaaaaaaaaaaaaaaaaaaactcgagactag

SEQ ID NO: 4638 - DNA, 501 bp, Homo sapiens
  misc_feature (375)..(375): n equals a,t,g, or c
  misc_feature (483)..(483): n equals a,t,g, or c
  misc_feature (490)..(490): n equals a,t,g, or c
  misc_feature (492)..(492): n equals a,t,g, or c
gccagaccaggagtgtccagtccttgggccttggtcagcctggagcagttgctcggccccctgtggtgggggcactatggagcgacatcggacttgtgaggggggtcctggggtggcaccatgccaggcccaggacacagagcaacggcaggagtgtaacctgcagccctgccctgagtgcccccctggccaggtgcttagtgcctgtgccacctcatgcccgtgcctctgctggcatctgcagcctggtgccatctgtgtgcaggagccctgccagcctggctgtggctgcctggagggcagctgctgcacaatggcacgtgtgtgcctyccactgcctgcccctgcacccagcattctctgccctggggcctnaccctgaccctggaagarcaggcccaggagctgsccccagggactgtgctcacccggaactgcaccccgctgtgtctgccactgtggagccttcagctgctccctcgntgactgnangagtgcccc

SEQ ID NO: 4639 - DNA, 847 bp, Homo sapiens; identical to SEQ ID NO: 3745
  misc_feature (20)..(20): n equals a,t,g, or c
  misc_feature (24)..(24): n equals a,t,g, or c
  misc_feature (37)..(37): n equals a,t,g, or c
  misc_feature (49)..(49): n equals a,t,g, or c
  misc_feature (96)..(96): n equals a,t,g, or c
  misc_feature (116)..(116): n equals a,t,g, or c
  misc_feature (193)..(193): n equals a,t,g, or c
  misc_feature (199)..(199): n equals a,t,g, or c

SEQ ID NO: 4640 - DNA, 1313 bp, Homo sapiens
ggcacgagaaggaatcaagttatgatttatagaggattcagctggaataccttgtgggtgctggctgagggtggcaaaacgcctaccgagacatgaaggttttagccactagttttgtccttgggagcctggggttggccttctacctgcctttggtggtgactacacctaaaacactggccatccctgagaagctgcaagaagctgtggggaaagttatcatcaatgccacaacctgtactgtcacctgtggccttggctataaggaggagaccgtctgtgaggtgggccctgatggagtgagaaggaaatgtcagactcagcgcttagaatgtctgaccaactggatctgtgggatgctccatttcaccattctcattggcaaggaatttgagcttagctgtctgagttcagacatcttggagtttggacaggaagctttccggttcacctggagacttgctcgaggtgtcatctccactgacgatgaggtcttcaaaccctttcaagccaactcccactttgtgaagtttaaatatgctcaggagtatgactctgggacatatcgctgtgatgtgcagctggtaaaaaacttgagacttgtcaagaggctctattttgggttgagggtccttcctcctaacttggtgaatctgaatttccatcagtcacttactgaggatcagaagttaatagatgagggattggaagttaatctggacagctactccaagcctcaccacccaaagtggaaaaagaaggtggcgtcagccttgggaataggaattgccattggagtggttggtggcgtgttggtgaggattgtcctctgtgcgctaagggggggcctgcagcagtgacagcttcaagaacttaacagccttgctcctgaagaactggctgcccaggaagccaagctagctttttaggggagtgttccagctgctggtagtggatcagcttagagggaacactcccacagccaaaagaatgagtgggagaaatggaggggacaatctcctgggagctatgcgcagtaacctaacttccttatgtcccatggatctcttcctgatcttccctgcccattgggtacccaggaaactgcaagcattgcctgtgttcctgggaagagttctaagaagcttgcattcattttctaccctttatgacttggatgcctccccacctccatttcccctcttctgagctgtgtattcatgtagagggatgtattcagcctttttagtgaacattttttttcaataaaagtaattcacagtaaaaaaaaaaaaaaaaaaaaaaaaaaaaaa

SEQ ID NO: 4641 - DNA, 1352 bp, Homo sapiens
gacaatacatgcatcatatcttttgactttgaaggatatctcatgtcaaaggaatcaagttatgatttatagaggattcagctggaataccttgtgggtgctggctgagggtggcaaaacgcctaccgagacatgaaggttttagccactagttttgtccttgggagcctggggttggccttctacctgcctttggtggtgactacacctaaaacactggccatccctgagaagctgcaagaagctgtggggaaagttatcatcaatgccacaacctgtactgtcacctgtggccttggctataaggaggagaccgtctgtgaggtgggccctgatggagtgagaaggaaatgtcagactcggcgcttagaatgtctgaccaactggatctgtgggatgctccatttcaccattctcattggcaaggaatttgagcttagctgtctgagttcagacatcttggagtttggacaggaagctttccggttcacctgkakacttgctcgaggtgtcatctccactgacgatgaggtcttcaaaccctttcaagccaactcccactttgtgaagtttaaatatgctcaggagtatgactctgggacatatcgctgtgatgtgcagctggtaaaaaacttgagactcgtcaagagctctattttgggttgagggtccttcctcctaacttggtgaatctgaatttccatcagtcacttactgaggatcagaagttaatagatgagggattggaagttaatctggacagctactccaagcctcaccacccaaagtggaaaaagaaggtggcgtcagccttgggaataggaattgccattggagtggttggtggcgtgttggtgaggattgtcctctgtgcgctaagggggggcctgcagcagtgacagcttcaagaacttaacagccttgctcctgaagaactggctgcccaggaagccaagctagctttttaggggagtgttccagctgctggtagtggatcagcttagagggaacactcccacagccaaaagaatgagtgggagaaatggaggggacaatctcctgggagctatgcgcagtaacctaacttccttatgtcccatggatctcttcctgatcttccctgcccattgggtacccaggaaactgcaagcattgcctgtgttcctgggaagagttctaagaagcttgcattcattttctaccctttatgacttggatgcctccccacctccatttcccctcttctgagctgtgtattcatgtagagggatgtattcagcctttttagtgaacattttttttcaataaaagtaattcacagtaaaaaaaaaaaaaaaaaaaaaaaaaaaaaa

SEQ ID NO: 4642 - DNA, 1277 bp, Homo sapiens
gggaatgtcactgcaaatgtctcgactgctgtgaggtgtgggcccctgcggtgggccaggcctttggaatctgctctgggctgctttctggaattgctccgtggctccccagctcctctctccacatgcaggcggcaggagggctgacagaacggctttgtctcacatctcggagttcttgggtggtgagtggtatgtgagtgacacaggaataagaggggagtatcagacagagacaagaggccttggggtccctggcagctttgatttgggggcattgatgacacttttgttggctcccatccatgttctgtgccctgggcttaggattttactcattttttttttcttttcgtcgcaataagtcatgaggcaatgtggctgttattatccccattttatagatgaggaaactgtcttgggaaggtaacgaatttgcccaaggccacacagctagcaaatgacacactgtgcttatamccagctctgcctcctatgcctgggccaacctgcccaagcctgcccaccactgagcatggcctgaccccacagaacgggcgccagtgtcagggctgactttcacagggtggagcgtggaaatacaggtatcttgggcctaactggctgagagggctttccccctscacggagccgaggaagctgtatttccagacgtctttcctagatggtttaattgatctgccaacaagtatttattggctcaatggctgagcagaggaggctggcagctagccaaggcttctggtattgatgaaggccagagagagtttgctctcacgatgactacaaggacactgtctccttgccagagctgcactcaagaccttctcgctagacccccgtgcatctcccggggtagtgaggtcctcccagcctccaggacatctggacttggcccctctgggcctggtcgcccctttgcccccatcccttatmaatytgtcctgaccccagctcacctccaggcctcagccgaggactctggctctgcatggggwgtttwkyactgagttcttctgcatctgsagggttactcatttttccacccataggccttcyttccccaagtggttatgaagttcctcagggcagggatggaaacccaggaggtatgcatggtgaactgggaagawtagggacatcatatgtgcctatttacttgatatcgcttggatatttgtttcctcmaaatctcgygttgaaatgagatccccmaasttggaggtgggggttggtgggaggtgattgggccgtgg

SEQ ID NO: 4643 - DNA, 654 bp, Homo sapiens
  misc_feature (17)..(17): n equals a,t,g, or c
  misc_feature (647)..(647): n equals a,t,g, or c
  misc_feature (651)..(651): n equals a,t,g, or c
  misc_feature (653)..(653): n equals a,t,g, or c
gcgaattcatttccganctgaggaagcaaaaaaccccgccaacaatgtcattccacccaccagtgccacaatgggtcagctgtaccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaaaaaaaaaaaaaaaaaactcgagggggggcccggtacccattggccctaaggggggggnttanant

SEQ ID NO: 4644 - DNA, 796 bp, Homo sapiens
accttcttccatgtttagtcccttgggctctgctaccctcctgctggaggtgagagcatcctgtgtgcaaccagagatgccctctggctttcagacctgcctgcttttcaccctcagccctttctcactcagcaaaattgtgggggtccctagtcagcagctccctgggcagctctctgagcaaggtggtctctgtggtcatgaaggagagccggctaggacagtgccggaaactcagctgcctctccccttcaactcagctggccccccgcacctgaagtgcacaggagccgggaagagagtctggagcccaccccggagggcagcacaggaggtgtctytgcagctggtgtcctgcmacccytgcaggcagmacacgtcccgggcattytcyttagccacagacagaacagccagtgccagagtctgctgtcgyttcccctttaagcacactcattcaccacacccgaggaggccagaggtgcagggagcatgggctgtcgttcccctttaagcacactcattcaccacacccgaggaggccagaagtgcagggagcatgggctgggtgcacctccgcaggagagaaggctgagccaccgccgtcccgggagcccggctcccaggcctctcgttttcccctacctccctaagacttttctgtcactctctggccattgaaaggcttctgttccttaaagtgctgttacactctcctttcccaggatgcagcaagccaaaacagtaccactgcacgtcagcctgggtgacagagtgagaccctatcttaaaaaaa

SEQ ID NO: 4645 - DNA, 1137 bp, Homo sapiens
  misc_feature (1112)..(1112): n equals a,t,g, or c
  misc_feature (1131)..(1131): n equals a,t,g, or c
ggaaccaccccccattcctgttcatttcagcagataatgatggagggggggggtgtccatcgtgctgagggtgtgaccgcaagagggtgaaaacttccagccaactttctcagwcctttctcttgcgagagggaagccacctgctatacaaactaataccccctgccttgaccccttccccacgactcagttgacagaaggatatactttgttataacttattattttgttctctgtaaatacaagatgtttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatcaaaaaaaaaaaaaaaaaaaaaaaaactcgagggggggcccggnacccaattcgccctatagngagtcg

SEQ ID NO: 4646 - DNA, 3531 bp, Homo sapiens
cttttttttttttttttgttttaagaaagtttatgaatttgtgttaggccccattcaaagccatatcctgggccacatgcggcccttgggccgggttggaagcttgccctaggaattttagatggagacgctctgtcttgccgggtgtagcacccgctcctgtggctcctttcctctccacactggccaagcaggagctgaatgctttggaggctccctgggcataaggcccaggtgaccactatgtgttggtgctcagcctttgcacatgctgtccctctctgtggaacacattccctggcccgcacatcttcctcacccccaattacctcccgggctccacacagtgcatttcctcaggtgctgcgctgaccagtgtggtagctgctggccacgtggctatggagcccttgaaatatttgagttccaatcaagatgtgtaagatacactccagatttcaaagcaaaagcaaaaacagctcattcacactttttatactgattttatattgaaatgaaaatattttggatagactgggttaaaaaaaaattaagttcacctgcttctttttactttttgaaatgtgactgtcagaaaatttaaagtcacatatgtggctcacactatttctgtgggacagccctgcctctagctaggggctttggtgagaaccagatgagttgatgggtctcctctgggccctgcttccctggctgctgaggtgcaggaactgtgaggggagggcagcctgtcacggtgcccaacacagggcagggctggacaggtacaagtggaacaggcggataagctgggaagggcacagagaaaaggagctcctcgtgacagcactttcccaccttttattattcaacacatggaagggggtggagacacaaggatagggcaatggtgagtttcaataaataagagaaacaggatggacaggcagtgggcccatgcctgcacggccccacataaataaccaggttgctgagccagagtggaagtcagggctgggcctggcagccgcctgcactgcccagaagcactggcaccacagggacacagaaaccactgaggcccaaggtgtgctccagccccaccaagtcttctccctaaagctcctgagatcttggggctggctgggcaggctagggctctgtatcacagtcctgccgggatcaagtctattttttcagtttcattaaaaacagctgggggaggggcaggcacatgcattaagccccttccgtaggcagagccatggatggacagccccatgggggccttgaaggcagaggccctggaagcagcaaaaacggggctggataaagctactaatgggagggatggtagagcccagctccccagtcccccacaacccagcccagaacctacaaagagctgaagaggccctgggtactgagacgtctctccttacttcacagtcagaaaaatggacccagcgatggccacagatgtgcccaagattagaacccagggactcactctcctagcccaggactttctgctaccccttccctttatagacctgctggaagaggagggggacgcacatctgctctagggccctgtacagaggcaagggtgtggctaattaccaaggaatggggccaggggtgacgggcacaggcccctcccctctgccaagcccagcctctgatgatacagagaatcccgtgggctcctaggatccagccagggcaggcacgggggtcggggcatccttcaggggagcaacatggcagcagggccaggggcggggctcagcctgctcctgtacacagtgcccgccggccacctgcctcctcactggggcagacgctcccacctccaggccttggtctttgctgtctcgtctgctgggccattgcttctcggtcctcacagtcccagctgcagctccacctcctccaggaagccttcggaacctcccagggcagggccgcagtgtccttagactagaccgcccctcagatgaccaggttgctctcacttagccggaccacatagcggttctcctcggccttgttctctgctgggggcttcagccactttgtacggcttccgccacttcctagcagggcctgctgctcaggggggaggccaggctgtggggagtcagggagatcaccccacgagggcccagcctccgtgatggtcttcacctcagacaccattgaacttgtccgctgctcaggaattcgagccacgcggaacctgcccacagacaagatggtgatctcgccctgacgccctgccttggccccggccttgggaaccctggtcgggttaggcagaaggctgggaacaggagtagtggcggctacagcctcaggggacagcagcacctcgggccacttcttctggctacagcgggagcagcaggggccagagagcgaggccaggccctgcacggtgtggagatggtggcggtgcgggcagatgtgtggcacgttcgggggcgctggcggcagcttggacacaggcctgtggctcgtctgcaccagctgtttgctgtggtactctttcagcagctcctccagggccgcagcattctctttcttctctgtgatcaagcgcaccaggaccccaatggtgtcctcattggcatcctcagtccggtaggcagggttgattccactgcctccacctccagggccgggcccgacctccttgtgcgccgtgcagtggtagcccttccgcttgaggaggttgcacaccaggatgcccaacagccccatgaggcagaagacagggacgatggcgatgaccgcgtactgggcggctgtctcctctgggccacctgcccgggtgccgttcccaggctgccgtgtctcaccaccgctgctggcccctgctgccacctccacgccacgtcgggcccgccgcccccactcatcacagccatgagtacccagaggtgcccaggaacatggttgacatggaacgcggggaaccccccaaggcccaaaccacccaggccagcagtctccacagagtgtatctcgagttgccatgcccacctgggcctccagcctcctccaaaggctgcaacgggcatggggctggcatgggctggagccccatgcagctgagaaggtgcctggggggcagggcctgcataatgtgccctgccctgggtccaggtcgggctcctccccaggtgggcactgccaaagggttgttgatgtcagggtggcgagaggccagggcagcagcataaggaagcaggacaggggccggcacagcagacttggcttcatcctcaggcccctggtggtcgccggcctggtctcggtccaagtttcccgggccggggaccgctccgggccccgccggcccctcacaccgcaagttccgctgcttccccgcgcgccccccgacagccaccacgcagggccggcccggagtcgcggccggaggacctgcaggtcacggggctcggagactggcggtggccggtgcgcggaaggcgccgggacaggacgcgcggacgcgtgggtcga

SEQ ID NO: 4647 - DNA, 757 bp, Homo sapiens
  misc_feature (709)..(709): n equals a,t,g, or c
  misc_feature (742)..(742): n equals a,t,g, or c
  misc_feature (756)..(756): n equals a,t,g, or c
cccctgggctgcaggaattcggcacgagctcagccccatcatgtgagctcaaagtgcttcacctcactgtgcctcagtttccatgtctgtaaaacagggtagaagtagaacttagaagagttataagaattaaactagagaagtgagcattgtttatatgtgcttgttgctatggatccaaaactgccagtaataacaataataataataataatagcttatgctttcgttgagcccttgctttgcacctggccagtgacaggcacattatcagtaacacaaatgcaagtatctcatctaacccttgcatcaacgctcagagatgggttttatcaacatccccattttacagatgaggaaaactgaggcagagcagttgcacaacgtcgcagctgttcctggtgcttcacccagatcctcattgccagtaaaccattcatcattcagcctttgctgatctgtgcctaatggcttataccaatactttcyccggagaattccttagctagcaaaagccatttcacccagggagttatgctctcacatgctgaactggccaatgactaagcgatatgaggcgagaggagtcacaaaaaagtccagtcctcccgcttcgaggcagaatacactccagagacccacgtgagatcaaggctagccttagcctgagagcccattcttgcttggctctgtcccttcccccatcatncttccttccctcacttttccttctcctgggaanccccaccttggatna

SEQ ID NO: 4648 - DNA, 1251 bp, Homo sapiens
  misc_feature (34)..(34): n equals a,t,g, or c
  misc_feature (53)..(53): n equals a,t,g, or c
  misc_feature (102)..(102): n equals a,t,g, or c
  misc_feature (137)..(137): n equals a,t,g, or c
  misc_feature (144)..(144): n equals a,t,g, or c
  misc_feature (1218)..(1218): n equals a,t,g, or c
  misc_feature (1243)..(1243): n equals a,t,g, or c
  misc_feature (1250)..(1250): n equals a,t,g, or c
aaagggcgatcgggtcgggcttcttcgctattangccagctggcgaaaggggnatgtgctgcaaggcgattaagttgggtaacgccagggttttcccagtcncgacgttgtaaaacgacggccagtgaattgtaatncgactcnctatagggcgaattgggtaccgggccccccctcgagttttttttttttttttgagaccgagtcttgctatgttgcccaggttggtgtgcaacagcgcaatgatcttggctcactgcaacctccgcctgccaggttcaagcaattctcctgcctcagcctcccgagcagcttgggattacaggcacgtgccaccatgcccagctaattttttatattttttgtatagacgaggtttcaccatgctggccaggttggtctccaactcctgacctcgtgatccgcccgcctcggcctcccaaagtgctgggattacaggcgtgagccacgcgtcaggcctaaagcccctgtttttttcactctctctttctttctcccgaaggccaaggctggaaagcctgtctccttgatgatgctctttttaamctacccttatgagtgtatttcagcaacctccmccgacccgaattacagtaccaccggctgcgtcctaatgctgtgccctctcctgatatggtctggctgtatccccatccaaactcaccttgaattgtaataatccccacgtgtcaagggcagggccaggtggagataattaaaacatgggggcagtttccgcatacggttctcatggtagtgagtaagtctcmcgagatctgatggttttataaatgggagttccgctgcgcaagctctcttgcctgccgctgtgtagcatgtgacttcgctgttctttggccttccaccatgattgtgagaactcctcagccatgtggaactgtgagtccattcaccctctttcctttgtaaattactcagtctcgggtaggtctttattagcagcgtgagaacaaatacacctcctgtcatcttctctccttggattcactcctctagtctgagatgtctggktcgccttgkttccccagcggtgggctcatgccggcaggggttggcatcagcaactgttctttgatcccatgactctgattttgagatgaacctggtgcagcttggtggtttcacgtggggccctttggaaggagaaaacctggtccgaatccctgcaagttgtgnggcgggttgggttccttggaagccnaagaatna

SEQ ID NO: 4649 - DNA, 928 bp, Homo sapiens
  misc_feature (884)..(885): n equals a,t,g, or c
cagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccccctgaacaccccaaaaggggttttttnnggttttggtttttgttttttgaaaacaggtccttgctttggtt

SEQ ID NO: 4650 - DNA, 792 bp, Homo sapiens
  misc_feature (767)..(767): n equals a,t,g, or c
  misc_feature (770)..(770): n equals a,t,g, or c
  misc_feature (776)..(776): n equals a,t,g, or c
  misc_feature (780)..(780): n equals a,t,g, or c
  misc_feature (782)..(782): n equals a,t,g, or c
cttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaagaaaaaaaccccccnacnaggctnttancntcctcctctc

SEQ ID NO: 4651 - DNA, 1458 bp, Homo sapiens
ggcacgagataaactgaaataggtcatgcaaatataaaatattatttttaaattatttgtcataagaaacgatggtggccatattttgctttaataatggaaaaaatgtggttagcattctgtggaaggtggtcatcagatagtagacattttctaggatttatttctacctgcatatgtggaaatgtgtactactttagatttatttaatggcagctaactcagaggcatcaaaatgtgctaatggtgtaatatggcctttgtcttgctgttctgttttgtaggccttcaatcaagcagggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggtgagtgcaagggagtagaaatctgcatcagcacatcagcacttggggatctaagtaaacctctcggggaaaatgaccaagtggatgtcatctcccagctgtttctaagagcccagatgtccagagtattgtctcaccttgatccctcaggccagaagacctgtgaaaaagccacactggttcagggactcactggacggttttgtgtccactctaacctgcaccgtctctaccccagagtggactcaaatcctcaagtcagtcctctgaacattgaagtcagaaattataaaagggctttggcaatatgttagcccaagaatttggcttcttccagaaattgtgccgaccttaacagtggcttaaatgatggtaaaacttttaagatttctaaaaggatggcattggagatacgttgacttttattaaacaacctatagttgtttaatgacttctaaaaaaatatctggagctcaggggttcaactgagggaacacatgttgagaatcattgtttactaattaaatgccaggtaaccgttgaaattatcaaaaacatcttccacgtaccagaaagcactcagaggatagttctgttatggagaagatgaaatggtttagtagtgtaggaactatggaaaggtgagcttagatttggatagtaaaacctcaagaccctatttaaaaagtattttatgaatgcagcataaataatttaattcagtgttaaatgccaaggctagtatattgagctgaatgtgaaaagaaactcacattgggagaatgccaccttttccttataagatagctttgaagataccattttagacagatggaaattgaatagctttagaaaaggcaaatgtttgatcttggggaaaaaaaaaaaaaaaaa

SEQ ID NO: 4652 - DNA, 1443 bp, Homo sapiens
  misc_feature (776)..(776): n equals a,t,g, or c
  misc_feature (907)..(907): n equals a,t,g, or c
  misc_feature (1288)..(1288): n equals a,t,g, or c
ataaactgaaataggtcatgcaaatataaaatattatttttaaattatttgtcataagaaacgatggtggccatattttgctttaataatggaaaaaatgtggttagcattctktggaaggtggtcatcagatagtagacattttctaggatttatttctacctgcatatgtggaaatgtgtactactttagatttatwtaatggcagctaactcagaggcatcaaaatgtgctaatggtgtaatatggcctttgtcttgctgtyctgttttgtargccttcaatcaagcargggcagggccgtacagtgaacttgtcctttgscagacgccagcgtctgcccctgaccccgtctccactctctgtgtcctggaggaggagccccttgatgcytaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggtgagtgcaagggagtagaaatctgcatcagcacatcagcacttggggatctaagtaaacctctcggggaaaatgaccaagtggatgtcatctcccagctgtttctaagagcccagatgtccagagtattgtctcaccttgatccctcaggccagaagacctgtgaaaaagccacactggttcagggactcactggacggttttgtgtccactytaacntgcaccgtctctaccccagagtggactcaratcctcaagtcatcctctgaacattgrrgtcagaaattataaaagggctttggcaatatgttagcccaagaatttggcttcttccagaaattgtgccgacnttaacagtggcttaaatgatggtaaaacttttaagatttctaaaaggrtggcattggagatacgttgacttttattaaacmacctatagttgtttaatgayttctaaaaaaatatctggagctcaggggttcaactgagggaacacatgttgagratcattgtttactaattaaatgccaggtaacccgttgaaattatcaaaaacatcttccacgtaccagaaagcacctcagaggatagttctgttatggagaagatgaaatggtttagtagtgtaggaactatggaaaggtgagcttagatttggatagtaaaacctcaagaccctatttaaaaagtattttatgaatgcagcataaataatttaattcagtgttaanatgccaaggctagtatattgagctgaatgtgaaaagaaactcacattgggagaatgccaccttttccttataagatagctttgaagataccattttagacagatggaaattgaatagctttagaaaaggcaaatgtttgatcttggggaaaaaaa

SEQ ID NO: 4653 - DNA, 2771 bp, Homo sapiens
ggcacgagagcgctyakggcgctgacccactgctcttcctcttaagaaagtgctccattccttccggcgcccggagctgctggcccaaagggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacarttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcaaaaaaaaaaaa

SEQ ID NO: 4654 - DNA, 825 bp, Homo sapiens
  misc_feature (2)..(2): n equals a,t,g, or c
  misc_feature (4)..(4): n equals a,t,g, or c
  misc_feature (9)..(9): n equals a,t,g, or c
  misc_feature (22)..(22): n equals a,t,g, or c
  misc_feature (767)..(767): n equals a,t,g, or c
  misc_feature (787)..(787): n equals a,t,g, or c
  misc_feature (800)..(800): n equals a,t,g, or c
cngncaacncccctactaattngaacaaaagcygsagctccaccgcggtggcggccgctctagaactagtggatcccccgggctgcaggcttttcagtatatccatagttttgcctttctaagaattgcatataattggaatcatgtagtatgtagccttttaacactggcttctttcacttagtcatatgtatttgttacctccatatcatttcatgacttcataactcattttttttagcactgaataatattccatcatctggatataccacagttttttttacccattcacctactaaagaacatggttgcctccatgttctggcaattatgaatgaagctattgtaaacctgtgtgcaggttcttgggtcgacataaattttcacctcctttgggtaaataccgaagaatgtgataatgtgattgctagatcaaacattaaaattatgcttaggtttgttagaagctgccaaactttcatagtgactggaccattttgcatttccaccagcaatgaatgagagttactgkttcttcacatccatgtcagcgtttggtgttgcagtgttctggcttttggctattttaataggtgtgtagtggcctctcatttgcatttccctaaggacatataatggggagcattatatgcctatttgccatttggatttcttctttttgaaaaattaattttgataaagaaatacttaacataagawctaacctcttaacaaatggtaaaagggacaatggacacaagttnacactctggtggtaactatngagacaatgctgnacattggatcttcagatccacatct

SEQ ID NO: 4655 - DNA, 4336 bp, Homo sapiens
  misc_feature (19)..(19): n equals a,t,g, or c
  misc_feature (46)..(46): n equals a,t,g, or c
ccatcgscccttgawtarnccggttttttycgcccctttgacgttngaagcccmcgttctttaaawagtggactcttgttccaaacttggaacmaccaytcaaccctatctcggtctattcttttgatttataagggattttgccgatttcggcctattggttaaaaaatgagctgatttaccaaaaatttamcgcgaattttaccaaaatattaacgcttacaatttgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgagttttttttttttttttttaaataaaccaaatgcttggtggagaagttgagcaggggagatgggcagtagaggttgccaagacagggcagggggtctggatgaggctgtccgatgcctgccagccacagtgatggtgcatggagggaaggaggagcagagagagaagataggcgtggcctccgggatgcccattctttttgcagagagcagcggcagtgggtccaggggtcctggaggggctggaagggggcagctggctggacatccagaagctttttcttccctcggccacgcctgcctggcggcctccagtccttagcctccgctccctctctctctccagatgcccgccccactccgtgtccatagcagtgacacagccacttccccagctccgtgtaattcccaagggagcagtgaaccccaccatctcaaagctgaagagctgctggccacacacatcctctcacggttttctccctccttctgaacgccggctttgctggccctggaatctctggaaaaataaactcaggaggtgaaaagttgacttggtttcttggtgtttttgttttctggcaggcagtgagaggaggggtgaaggaggagtttggtgccatttctctttctgctttttcctcttctgatgtcaaacaaatgatgaaaatcctgctatgggagcccgggagcctggggccaggctgctggggggacggtagagggtgctctgctgacttggggggttaggggggttctggggcgttggagtccgactggccttgggccgaaagaggctgccctgctgggtgctggtgctgttggtgacggtggtgtggtctggctcacccgagtcgctctccgtgtagctgtaggcctgtgccctcgagatgcccttctgctgtcgccgccacgagttgtagtatgtggggtcactgatgtagtggttgacaaaggagtgggccttctggtggtttgagtcgacctcgtactcgctgtcacttccctgagagtcggagatttctgagggcttctccgtcaggctgctgctctctgcagggatgaggtcgttgwatttggtgacatcctcatccgagtagtgcaggctgcctgggctgggcctggggggagacctggtgtacaggccgttctttcggcagaaagagttcttgacggagagccgcctgttgttgagttccagggcagggaagctgctttcatccaagctcatcatctcgctgtggcctagggctccagacttggcactgttccccgagtctgtcttcttggcgtacttcttgctctggccccggatgatgagcacgaagaccagaagcaggatgaagatgaggccgaccagggcaatgaccaccaagaaccaccactcctcatagaaggggttggctttctgggctggcacagactgggaggggctgctgggggtgccgaaaccatagtcgttgaccgcgatgacccggaagtcatagctcacgcccggcttcaggatgtccatgctgaacgtgtaggagctcacctccttggggatgtctttgatgaggatgtcccatagtccctcgtctgaaggtctggcctcgatgacgtagcgggtgatgggccctttgcccgggtctccgctggaccagtgaatggcgatggcagagctgtaccgcacgatgatgggcacgccaggcggtcctggggcaccttctccggggcccgtggtgacgttggcttcgatctccggcccgtaggtgaaggtcttggctctgatgcggaacctgtaggtcaccccctccgccaggtccttcaccttcagccacagggggctgttccccttcacgtccacggtcacgatcttgctgactccatccacggggctgcagggctcgtacaccagcctgtagccctccaggatgccattggggaactgcggggcttcccaggacacattcactgaggttgtggtcagctcactgaacttgaccgagctggaagcgctgggggctgcttgctgggtctggccttgggtgggggtgctccgaggcccatccccagcggcgttgaaggcggccacgctgaccatgtaggccgtgtagccagtcaagttcttgagcttcacgctgttctcagccaggaaaagcgtcttcactcgctctgtgaggttcccccgctgggcttcccagaaataaatcttgtacccctggatgtctccattctggctgtccagcggaggtggctcccaagtcacgtccagctgtgtggccgtggcgccgtggacgaccacgttacgaggtgctgctgtgggcactgcctccccaacaaagacctcctgcggggggctggagggcccctcacccacagcgttgtacacgctcatccgtatctcgtaccgcctgtgcttgttcaggtaggtaagctcagcccatgtggcccctgggttgttgatgcctcgaagcgtgaagcccctcagtccttcatagagcagctcccggtatcggatccggaagcccaggaggatgccattgatcttgtcctctgctggcggctgccatcggattagcacggaggtggtggtgtggggcgtcacggagaggatggtgggtgcttcatcgggggcagcctgcagggtggtcagtgactccgactcctcgctgaactcgctgtcgccaatgtcattggtcgccttcactcggaacttgtaggacgtgaagggcttcagcctgtccacaatgaagctggaggcattgtggctcacggaggccgagtgcagtgcccacctgccgctgggcagctcgcgggtctggatggtgtagtagcgcacaggggagagcccgtcgctccctggctcccaggacagcagcacgctgcgtgctctcacatcctcctgctgcaccatcggcctgctggggggctgcggacggtctctcttctcggtggtcaccaccaaggcctcggcagcttctccccagcccttgcgggtctgggccgtgatgcggaacaggtagacagactctggcttgaggcccgtggctgtgtactgccgggcgytgggtgccagcacctccacagtggcggtgttggccgtggtggtgttgagccggtgtgtgatctggtaagcaagaatgatgccattgggggcggcagggggctgccagatcagccgcacagacgtggtccgcacctctgggaacaggatgcccatgggtggtcctgggacatcatccagcgtccgctccaggatgggagggtggctggggctgccgtccccgatgcgtgtgaaggccagcacctggacttcatagagcacgtatttgcccaagccggtgagctgggcactgcgagacgagttgccttccaccagccagaatcggggctgggtgtccgagtccttctccttatacatcaccttatagcccagcacgagaccgttgcgatcagcctcggggacctcgctccagcgcaccagcatgctgctggaggtggtggccagtgcagacacattggtggggccggaagagggaactgactcccgggtcctgcccaccaccgtctggctccagggcccgctcccgatggcgttgaaggcctggacctggacgcggtactctgtccctcgtgccgaattcctgcagcccgggggatccactagttctagagcggccgccaccgcggtggagctccagcttttgttccctttagtgagggttaatttcgagcttggcgtaatcatggtcatagctgttcctgtgtgaaattgttatccgctcacaattccacacaacatacgagccggaagcataaagtgtaaagcctggggtgcctaatgagtgagctaactcacattaattgcgttgcgctcactgccgctttcagtcgggaaactgtcgtgccagytgcct

SEQ ID NO: 4656 - DNA, 570 bp, Homo sapiens
  misc_feature (10)..(10): n equals a,t,g, or c
  misc_feature (20)..(20): n equals a,t,g, or c
tgctctgacnggcttacctnacttagcataatgacctcaaggttcatccatgttgtagcacgtgttggaatgttcttcttttttcaggctaaataatatcccactgtatgtatatgccaccatttaaataatccattcatctgccaaagaacatcaggttgttgtcgccacttcttgactactgtgagtagtgctgcagtgagcattggagtgctaatatctgtttgagatcctgatttcaatggttttagattggattgctgcatcatmcagtatttttatttttaattttctgagaaatttttatactgttttccatagtggctgcatcattttgtattctcatcaatagtacaaggtttcccatttctccacatccttaccagcatgcttttttattttttttttgataatagccattatctaaacaggtgtgaggtagtatctcatggttttgacttgcacttctctgatgattagtgtgatgttgagtatttttcatatacatgttggccatttttgtcttctttgaagaaatgtctattcgagtccaggcccatttttacgttg

SEQ ID NO: 4657 - DNA, 1264 bp, Homo sapiens
ggcacgagagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggaaaaaaaaaaaaaaaaaaaaaaaaaaa

SEQ ID NO: 4658 - DNA, 1671 bp, Homo sapiens
ccacgcgtccgggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttttgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggaaaaaaaaaaaaaaaaaaaaaaaaaaa

SEQ ID NO: 4659 - DNA, 2232 bp, Homo sapiens
gctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggaaaaaaaaaaaaaaaaagggcggccgctctagaggatcc

SEQ ID NO: 4660 - DNA, 1361 bp, Homo sapiens
gttattgtttttttttttttctactactaattcctagtggtgcacaacgagtttctgagaacacagtaataacgccaaagtagcagtgcatctgagaaacataatttttacctcgttgctttcccaaaaataaatatctcagtcatggaaaacactgtttatttgaaaacaatgagacctcaaatatgaaatatagttaacaatgacattgacactgttgctagcactttcccctaaaccacccgtaagtcttggacgcatgtgcatgcagcacacacacacacacacaaaaaccaaaaacaaagccaaaaaaaaaaaaatcccaaacacaacawtccatgattgttcaatgactcctgatgccgggaggacaggctgttaaaagaatttgtctcccacaatatctctggagtgggcacaaagcccatcacctgttagtgatcacagacattcagttaacctgtccttccagtaatcagagacaacaattcagaccctggacttctcagaatccatgtactgctgagtcttggctttgagacaagacaagtcttggctaaattgaggcaggacagcagccccttccatatgtttggtcccatttgatagaaagtctaatttagagttataaatgtgctcatctatttactctgagctcaatctaatttgacaggtaattcctcacattttctccattagccagctgagagtcagctgtggtagagacacacgacatgggttcaagcccctcatgagccctgtggtggctggcaagtcctttcctttctttaagccttaatctcctcacttgatagagggggagaaattgacccaatgatgataaatattgtgtggttctatatttctagcctagacaattgttgctcaagtgtaacatgtgactgccaaataggatatctcttaagatgaatatctcctaactttcctcacctggtatgatcacatattctggcttcctctaaggtttagaatctgtaggttcaaaaaggtcttgaagaccacctagcatatttctattctgatgagagaaactccatccaagcagctgtactttttcaacttgaaaatctccaaggaaaagagccttttccttctgttgactaatgtttagatgcagaccagggaatctttcctgtcacttggctkwwytcccttgctaaaacaacataagacaagtatywkwtcccctttattggaggatccaagggaagatyagctggtcactaaagtccagaaagcaatggagtcttatagctcattcctgggatgttgcaaataatgccaaactctgatgtactcagactcaacttctaggattatcattcactaaatgcctgggt

SEQ ID NO: 4661 - DNA, 820 bp, Homo sapiens
  misc_feature (721)..(721): n equals a,t,g, or c
  misc_feature (783)..(783): n equals a,t,g, or c
  misc_feature (802)..(802): n equals a,t,g, or c
cgagattggcacgaggtgscacgaggtggcacgaggymgattctcaatcaagtcctttagccttattgattaaaatagagacatttactatcacaaaatgatgcccccaaacagcctcaaacctgacacattagtttccctttcctgcctctgcccaaaatgaatgtttttctttctcttcccttgggttcttctctccctcccctcctcttccctccctctctcccttctctattcttccctctccctctctatttgtccttctctgctccaagtcctgccacaaccccaggattcatcagcctccctggacacatcccatccagctcctgaccgctcacctccttcactcctcatcctcagggccctttcctccatctgcctcagcccatgccagcggccatgctgtgcacctggaggggccacccacctgccaggaaacagcacattcagccatgcacctgactgcagcctccactctagcagattagctcagtcacctgtgacacactgttcctctggctctttgggactttcagcccatggacacctccatgcccatccctcaatctctgtttctccacatctctccctttccatctcaaatccatgctccagcaccaaacactaactctttccattctaaactccctctccccattgktcttcccttacaggcacctggcaaaatccagtcctcaacaaatgcagccaatggsgnttgstaatgscagcaaggctggcctgtcaactgtggtctcctccctcagstgggsctgsarnagaatccggaacctggtgntcctarttcagtctggtc

SEQ ID NO: 4662 - DNA, 357 bp, Homo sapiens
  misc_feature (20)..(20): n equals a,t,g, or c
  misc_feature (23)..(23): n equals a,t,g, or c
cccaacccaccccaatttcnggncttattctgtacaccccctccccttttgaaatccctgataaaaacttgctggttttgcagctcaggttggcatcacggtcctaccgctatgtgatgtcacccccagcagcccagctgtagaattcctctctttgtactctttatttctcagaccagccaacacttggggaaaatagaaggagcctacgttgaaatattgggggcgggttcccccaatacttctgaaactattccaaacaattgaaaaggagggacacctccctaactcattttatgaggccagcatcatcctgatactaaaacctggcagagacacagcaaaaamaaaaaaaac

SEQ ID NO: 4663 - DNA, 794 bp, Homo sapiens
  misc_feature (645)..(645): n equals a,t,g, or c
gaacaagggaagacaaccataaggtctgactgcctgtagggtcrggcaaaaagagccatatttttcttcttgcagagagcctataaakgggtgtgcaagtaggagagataycgctaaattctttycctagcaagaaatattaatattaagaccttaggaaaataattgcatcccttgggggaggtctataaatggccactctgggagtgtctgtcttaagtggttgagataaggccctggtctcctgcagtaccatcaggcttactaggattgggaaaccccaaccctggtaaatttgagttcagactggttctctgctcttgaaccctgttttctgttaagatgtttatcaagactatatgtgcactgctgaacgtagacccttatcgggagttctgattttgtccttgctgtgtttcctcagaagcatgtgatctttgctctgctttttaccccttaaagcatgtgacctactccctgtttgtacaccccctccccttttgaaatccctgataaaaacttgctggttttgcagctcaggttggcatcacggtcctaccgctatgtgatgtcacccccagcagcccagctgtagaattcctctctttgtactctttatttctcagaccagccaacacttggggnaaatagaaggagcctacgttgaaatattgggggcgggttcccccaatacttctgaaactattccaaacaattgaaaaggagggacacctccctaactcattttatgaggccagcatcatcctgatactaaaacctggcagagacacagc

SEQ ID NO: 4664 - DNA, 2102 bp, Homo sapiens
tccagaccatctacaactgcacggcctggaacagcttcggctccgacactgagatcatccggctcaaggagcaaggttcggaaatgaagtcgggagccgggctggaacagagtctgtgccgatggcgtcatcattggggtggccgtagagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggyaagcagcgtgtgcccacaggcatgtccttcaccaacatctacagcaccctgagcggccaggggcctctacgactacggcagcggtttgtgytgggcatgggcagctcgtccatcgagytttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccaraggtgggcgggtggggagacagacagaggctgcggctgagtgcgctgtgcttagtgctggacacccgtgtccccggccctttcctggaggcccctctaccacctgctctgcccacaggcacaagtggcagctataactctgctttcatgaaactgcggtccactctctggtctctctgtgggctctacccctcrctgaccasaagctctacctacccctgtgcctgtgctcccatacagccctggggagaaggggatgacgtcttcccagcactgagctgccccagaaaccccggctccccactgctgctcatagcccataccctggaggctgacaagccagaaatggccttggctaaaggagcctctctctcaccaggctggccgggagcccacccccaatttgtttggtgttttgtgtccatactcttgcagttctgtccttggacttgatgccgctgaactctgcggtgggaccggtcccgtcagagcctggtgtactggggggagggagggaggagggagcctgtgctgacggagcacctcgccgggtgtgcccctcctgggctgtgtgaccccagcctccccacccacctcctgctttgtgtactcctcccctccccctcagcacaatcggagttcatataagaagtgcgggagcttctctggtcagggttctctgaacacttatggagagagtgcttcctgggaagtgtggcgtttgaaggggctggagggcaggtctttaagatggcgagactgcccttctcagctgataaacacaagaacggcgatcctgtcttcagtaaggctccacgagaagagaggaagtatatctacacctcaaccctcctagtcaccacctgaaataaatgttagggacactactccaacatgtttgttctgttcttttgttcctacaaagccacaggaagaacccaagagctcatagaatgcgttgggaacccaaggttctctgccctcctttgattcaatcatcctagacaataaaggcagttgatagctctgaaaaaaaaaaaaaaaaaaaaaaaaaat

SEQ ID NO: 4665 - DNA, 263 bp, Homo sapiens
  misc_feature (14)..(14): n equals a,t,g, or c
gacgggggacgggnaggaaaaagggaagctcctatagggaaagctggtacgcctgcaggtaccggtccggaattcccgggtcgacccacgcgtccgataggggtacatttacattctgtaagagattgagcctgaactctcttagtcataaaaacatcaaatggccacatgtccactaccaagcttcttctatgttaaaaaaataataataaagcagttttaacctgcaaaaaaaaaaaaaaaaaaaaaaaaaaaaagggggg

SEQ ID NO: 4666 - DNA, 2135 bp, Homo sapiens
ggcacgagggcggctgctgccatggtggctggcggccgggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgttaaaaaaaaaaaaagggcggccgc

SEQ ID NO: 4667 - DNA, 1042 bp, Homo sapiens
  misc_feature (487)..(487): n equals a,t,g, or c
  misc_feature (522)..(522): n equals a,t,g, or c
  misc_feature (1026)..(1026): n equals a,t,g, or c
ggagctctgcccagttctctaggtcttcagactttgacctggcccaggttttccatctgcatgtgaggagcaactggacaccggacagtggtaggacttgaatgaccagaaagtaaatggacaggaagccagacagactttgcatggaatgtggaaaagtccagagaagaattggctccttatgacatgaagaatgaatgaggtcccagcacataacatggtgccttcttttctccagtcccctggctactcttccagcagcattaccactgggtgcctgtgcagcagtattcactgtgataggaagtgagaagcagtctgagtgttcattgctgagggaatcaagggcaaaatatcatggatgcactcatggacaaataagcagcagtttgaagcaacaccctagatggatgtacagccatcaagaggatcttaaagtgtggtctttagtggaaaaaaagcagaagcaatgtatgggagactgagnaattacatatgagctcacatcactatctcttccgncactgtcatccatcatgactgatctgggagatgaaacagcacagatctaaaggacgtggctggagwrcaatggcatggtatcggctcactgcggcctctgtctcctgggttmaagcgattttcctgcctcagcctcccgagtagcwrrrattacaggcatgcgtcatcatacctagctaatttgtcccatagaatctcatcttctggattttgtggctattttttcatggtgttgattcattcataaggtaaaatttatatacagtgaaatgcattttatgggtacaattcaatgagttttgaaaagtgtgcacatccatgtaaccaccacccagattaagacacagaacattcccgtcacctcagaatgtttcccggtgccttcytcctacccctcatacagtaacattgtaataatttctattgccacatatatgtttacctgttctgaaacttcacagaaatggaattatatattatgtatttgtttgttaaaaaaaaaanaaaaaagggcggccgc

SEQ ID NO: 4668 - DNA, 2147 bp, Homo sapiens
ggacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggaccccatctgatcctttgctgcttttttggcttggtcaggtcctggcctcattttggcgttacctgtgtcagagttcaaggtggatgtgcttagagctggtcagccccttccagacctggacacgtctgtggctccttttctttcttcctttttttttttttttttaaaaaaaaaaaaggttcagcagaaatcagcgtggctagttcacaaagaatttccagtatcagggaaaaactgtgcgtgtgtgtgtgtgtgtgtgcacgtgtgtgygttgccgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggmagaggttcaggtgagagtggctcacctctgagctggtgaagtgaggacttgcctgtgacatgacccagggatctgctgctggcttctggagacagggccttgggctgacttctcaggttgattgaggcctcctgactagcggtgttcccaggmtagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaaaaaaaaaaaaaaaaaaaaaaaaaaa

SEQ ID NO: 4669 - DNA, 657 bp, Homo sapiens
  misc_feature (607)..(607): n equals a,t,g, or c
  misc_feature (609)..(609): n equals a,t,g, or c
  misc_feature (618)..(618): n equals a,t,g, or c
  misc_feature (646)..(646): n equals a,t,g, or c
  misc_feature (651)..(651): n equals a,t,g, or c
gagtaatctgaacagaaatgtgtaacaattttgccacacattaattcttctatattatcttaacagctttattttccatcctgagtctattttttagtctaatgatattgagtagatacttaattatgtcagtctattatgtcagtttttaaactccaatgttcatcttttcttgatttatgctaccaactttattatgtattacattcttataagtagatgagtctgtttctgacgcttgctctctgttctgttctacttgtccatttaaatgttcttgctcgaaattgtttctatgacagtggctttgtagtacatccatggatttggttgggacactccctcccctacttctacttttctcctctttctcaacgtttatttagttatttgtggacctttatttttccatgtagattatagaggttttcagagaycctcagaaaacccaactgaaatcttacttgagggtaatttgggggagaattgagaatttatgataataaaccaccctttccaaaagtatagactggcttcccaaatattcttctcatcttaaaaggtctttagactaaattagactaataagccttctcaaaatctgcananaggaaaggnctaaggggctctttctctaagttataangggcncttaaa

SEQ ID NO: 4670 - DNA, 1278 bp, Homo sapiens
  misc_feature (1134)..(1134): n equals a,t,g, or c
  misc_feature (1141)..(1141): n equals a,t,g, or c
  misc_feature (1175)..(1175): n equals a,t,g, or c
  misc_feature (1180)..(1180): n equals a,t,g, or c
  misc_feature (1226)..(1226): n equals a,t,g, or c
ggttgaaacagtttggagggctcagaagaagacaagaaaatgtgggaaagtttggagcttcctaaagacttgttgmmtggctttgacaaaaatgckgataytgctatggacaataaggtccaggctgaggkggtctcagatggagatgaggaacttgtagggaactggagcaaagatgactgttgttatgttttagcaaagagactggtggcattttgcccctaccacagagatttgtggaactttgatcttgagagagatgatttagggtatctggctgaagaaatttctaagcagcaaagcattcaagaggtgatttgggtgctgttaaaagcatttcattttaaaagggaaacagcataaaaatttggaaaatttgcagccagttgatgcagcagaagagagaaacctgttttttgaggagaaattcaagctggctgcagaaatttgcataagttacagggagctgaatgttaatctccaagacaatggggaaaatgtctccagggcatgtcacaggtcttcatggcagcccctcccatcacagaccctgaagactaggaggaaaaaatggttttgtgggccaggcccagggtccccatgctgtgtgcagcctagggacttggtgccctgcatcccagctgctccagccattgctaaaagggccgaggtacagctctgcccatggtttcagagggtgcaagccccaaaccttggcagcttccatgtggtgttgagcctgcaggtgcatggaagtcaagaattgaggtttgggaacctccatctagatttcagaagatgtatggaatcacctggatgctcaggcaaaagtttgctccaggggcagagccttcatggagaacctctgctagggcagtgtgaagggaaatgtggggttggagccccyacacagaatccctactggggcaccacctagtggagctgtgcgaagaaggccaccgtccttcagaccccagaatggtrgatccaccgacagcttgtaccgwgcacctggaaaagccacagaccctaaacgccagcccgtgaaagcagccaggagtggggactataccctgtgaagccacaggggcagagctgcccaagactaagggaacctacctcttgcatcattgngacctgnatgtgagacatggagtcagaggagatcattttgnaacgntataatttgactgcctcgctggattttggacttgcatggggcttgnaacgccttttgttgtggcagtttctcccatttggaatggctgtatttacccc

SEQ ID NO: 4671 - DNA, 1031 bp, Homo sapiens
  misc_feature (25)..(25): n equals a,t,g, or c
  misc_feature (29)..(29): n equals a,t,g, or c
  misc_feature (88)..(88): n equals a,t,g, or c
  misc_feature (109)..(109): n equals a,t,g, or c
  misc_feature (118)..(118): n equals a,t,g, or c
  misc_feature (1016)..(1016): n equals a,t,g, or c
  misc_feature (1029)..(1029): n equals a,t,g, or c
  misc_feature (1031)..(1031): n equals a,t,g, or c
tcttttcagcagcaccccattccantggntaccaatttacctgtattagtcagttttcaatactgcttgattaaagccatttccaagnctggaagaaaaagaggtttanctggacttncagttgcacatggctgggaggcctcaaatcatggtggaggcaaaaggcacttcttacatggcagtggcaagagatacgagagagaagtaaaggtgcaaacccctgataaacccatcagatctcgtgagacttaattcactatcatgagaatagcatgggaattcatcattgaatcaatcattgaaaagaattagcagaggactgataaataagcatagaaagataggaagagcatttcagattcaattacctccccgtgggtccctcccataacatgtgggaattctgggagacacaattcaagttgagatttgggtggggacatagccaaaccatatcaaggatagtcattttttctctgctgtcatatttatggcaaggttcattgttcactcatctggtctccatagttaaaacatttctttgaaaatactttaaccagattcataatattttataagatatgtaataaactgaatgtttgtgttctttcctccaccctcccattcacataggaagctctaacctcaatgcaatggtattgggaggtggggcatttggaaaataattgtgcttagatgaggtcaggagggtagatcccccttgatgggattagtgcccttataactagaggaagagacactagacctttctctctgcagaatatgagaaggcatattagtctaaattagtctaaagaacatataagatgagaagaataattggggagacagtctatacttttgggaagggtggtttattatcataaaatctcaattctcccccaaattaacctcaagtaagatttcagttgggttttctgaggatctctgaaaacctctataatttacatggaaaggtccaaggtccacaaattttctaaataggaagctgaganagaggaggattanan

SEQ ID NO: 4672 - DNA, 875 bp, Homo sapiens
  misc_feature (290)..(290): n equals a,t,g, or c
  misc_feature (319)..(319): n equals a,t,g, or c
ctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagrtcaccatacctaagcagcmacgctatggggaaaggaatcatrgncccatgccaaccccacaatgccagataanccaagtgaaattcargtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagtatctgaatcaaaaaaaaaaaaaaaaaactcgag

SEQ ID NO: 4673 - DNA, 1923 bp, Homo sapiens
aattcccgggtcgacccacgcgtccggtaagaactaaatcactagggtgcatcagtttgttaggcgcctgctgtgaagcactttagatcctcatgcagcctccttttgttctaaccaccaccaccatgatcagcctattcttggcactgatcagcaccaagaaggtgcatctgacaatacctcagccctttacttcccactccagactttcttttgatgtttttaaaagaaaagcaagagcctgacagtagtaaagtggtgaaaacatatttttctattgcagcaggggaaaagagacctcattataaaactgggctcaattctgaatgcagcatggacaagtggggatttatagccaataagcagactgggggtcaggggatagaaagttactaagtggaaacatcaggaaaatttctagctaaaccgatctaacataatgcttgctgaaggcaagtgagggtaattaggtatcacctgggggatgctggaggatgagaaacccagtaagatactgagagtgatcagatattaatggtgcgggggttcttactaaactgacttagcagaattcttcctcttgagtataaggcccaacgacagagactagtcaaagcagggatgagagaagcctggctagagtttggagagagtcattgtcaatataaattttcaggacaccttgggaccctgtttagcacccatgtttttcaacccagaaatatggggagacatagcagtctgtctgtgggcttagcatttcaccaatgagaaacaggagctgatgggtatatttaccattccatttctccacaccttccatcactggactattctgatatatagattgtgtactatattgacttctcagaagaagatccaaagtggctaagaatcagtcatccctaatggcctcaaatcggctctctgtctttgcctgtgattttctttgtcctcacgtttgcttccttggattgaacacctaatgaagtagtagcaaataaaatatttgcctgagagttggctttctaagaatcacaggtaagatactcagttcgaacttttgttgttgctgtcgcaagttgcagaacattcaaaccagaaatgcctggtggtatgcaagttttagaaatgactcaattcagggcagaaacattatcagcaggatgtgatttctatccaattcttgcttggtttgcaatggcttggctttattctgaagcttcgtttaacaacaaaatgatagtgtttatgtagttcttgaattccaggtctcagagcaaaattaagtgaccttttcacataacatactgccaatgtatttttaatgtaattgtcctgattgagtcatatttctaccaaattaccaaacacttttgtaatattagcttaagatatgttctcattccttgcattagagatggtgtcagcttgacttgaactttaatggcctgaaagtgagagcaatggtgtttcaccagagggaaattgaagtttggtcgtaagaagaggtctgagtggctgctgcaaagtcaacatttgttatccacataggacacaagctgttgtgttataaaataccatcagagatagaataagcattttcttacttcaaacttctaaatcagaagcatctaggaacatagctgtaattggtgaagcacagaaataaaaagacatttctaggtgaatcaaaatcagaggaagtcattgtcattgtgtgcatggttgcacaaaagcatcagggagcccagcagagtggtgcattaaagaaataagaaaagcaacgtctgccagcagtcaagacaggtatctgaagcagcagttgaaacagatgtgaagtagaggcaatgccatgaatgtcagttgtgtgttttagtgggtcccattgactcttggagattagaaaaaaaaaaaaaaaaa

SEQ ID NO: 4674 - DNA, 695 bp, Homo sapiens
tttttttttctaatctccaagagtcaatggracccactaaaacacrcaactgacattcatggcatkgcctctacttcacatctgtttcaactgctgcttcagatacctgtcttgactgctggcagacgttgcttttcttatttctttaatgcaccactctgctgggctccctgatgcttttgtgcaaccatgcacacaatgacaatgacttcctctgattttgattcacctagaaatgtctttttatttctgtgcttcaccaattacagctatgttcctagatgcttctgatttagaagtttgaagtaagaaaatgcttattctatctctgatggtattttataacacaacagcttgtgtcctatgtggataacaaatgttgactttgcagcagccactcagacctcttcttacgaccaaacttcaatttccctctggtgaaacaccattgctctcactttcaggccattaaagttcaagtcaagctgacaccatctctaatgcaarraatgagaacatatcttaagctaatattacaaaagtgtttggtaatttggtagaaatatgactcaatcaggacaattacattaaaaatacattggcagtatgttatgtgaaaaggwcacttaawtttgctctgagacctggaattcaagaactacataawcactatcrktttgttgggcaaatagcct

SEQ ID NO: 4675 - DNA, 1024 bp, Homo sapiens
  misc_feature (2)..(2): n equals a,t,g, or c
  misc_feature (24)..(25): n equals a,t,g, or c
  misc_feature (917)..(917): n equals a,t,g, or c
  misc_feature (920)..(920): n equals a,t,g, or c
  misc_feature (948)..(948): n equals a,t,g, or c
  misc_feature (956)..(956): n equals a,t,g, or c
  misc_feature (958)..(958): n equals a,t,g, or c
  misc_feature (997)..(997): n equals a,t,g, or c
tntttggggagcccgccctatatnncaaactgggggtcaggggacccaaagttactaagtggaaacatcaggaaaatttctagctaaaccgatctaacataatgcttgctgaaggcaagtgagggtaattaggtatcacctgggggatgctggaggatgagaaacccagtaagatactgagagtgatcagatattaatggtgcgggggttcttactaaactgacttagcagaattcttcctcttgagtataaggcccaacgacagagactagtcaaagcagggatgagagaagcctggctagagtttggagagagtcattgtcaatataaattttcaggacacyttgggaccctgtttagcacccatgtttttcaacccagaaatatggggagacatagcagtctgtctgtgggcttagcatttcaccaatgagaaacaggagctgatgggtatatttaccattccatttctccacaccttccatcactggactattctgatatatagattgtgtactatattgacttctcagaagaagatccaaagtggctaagaatcagtcatccctaatggcctcaaatcggctctctgtctttgcctgtgattttctttgtcctcacgtttgcttccttggattgaacacctaatgaagtagtagcaaataaaatatttgcctgagagttggctttctaagaatcacaggtaagatactcagttcgaacttttgttgktgctgcgcaagttgcagaacattcaaaccagaaaygcctggtggtatgcaagttttagaaatgactcaattcagggcagaaacattatcagcaggatgtgatttctatccaattcttgcttggtttgcaatggcttggctttattctgaagcttcgkttaacaacaaaaatgatagtggttatgnagntcttgaattccaaggctcagagcaaaantaagtgancntttcacataacatactggcaaggattttaatggaatggnccggatgagcataattctaccaaatac

SEQ ID NO: 4676 - DNA, 1439 bp, Homo sapiens
  misc_feature (751)..(751): n equals a,t,g, or c
acacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcargggcttggncctaaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaaaaaaaaaaaaaaaaaaaaaaaaaaaaaaaaaaaaaaaaaaagggcggcc

SEQ ID NO: 4677 - DNA, 334 bp, Homo sapiens
  misc_feature (280)..(280): n equals a,t,g, or c
  misc_feature (324)..(324): n equals a,t,g, or c
  misc_feature (326)..(326): n equals a,t,g, or c
ggttatttacattagccaagctgtggaaacaacctgaatgtccactgatagatgaatggataaagaacatgtgatatgcatatataatggaatattattcagccttaaaatgcagatactgccatttgccacaacatggatgacctggaggcagtatgctgagtgaaataagccagacacaggaagaaaaatattgcatgatctcatatgtggaatcttaaaaaaaaaaaaaaaaaagagtcaaatatacagagtgaataaaagagtgggttaccaggancaagtgggtggggaatgggaaatgtagtgaagggtagaaaattncnagttttta

SEQ ID NO: 4678 - DNA, 605 bp, Homo sapiens
  misc_feature (2)..(2): n equals a,t,g, or c
  misc_feature (19)..(19): n equals a,t,g, or c
gnccgttgctttacttttngcttcaccgacatagtcattatgccgaagagaaagtttccagagaatacagagggcaaagatggatccaaagtaactaamcaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagagatccacatctctcgctcaactgttaatgtctcaacctccagaggcaccccacccagcacactgtcagtaaaggggcagattgaaacagtgagagttaagggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacatttaaaaaaaaaaaaaaaaagggcggccgc

SEQ ID NO: 4679 - DNA, 1484 bp, Homo sapiens
  misc_feature (1484)..(1484): n equals a,t,g, or c
gcagtgatatgcctgtttttgtgtgttccatcggactttgtttccttttttcgattttgttattgtttccaccttttcaattttcttacatttgttggctctctcaagcttctgtttattccccttctccctcccttagtaatttggaagttctactctgcttatcaattcttctgatgattatctttccattccttataagcataawtmacatttwctctattggtagattaagcacacacatgggcgcacacacacacacacacacacacacacacacacacacacacacacasgtgtgttactggcctttactcctaatttctcaggagaatgaaccatttagaatgtttttacctcttcattctgccctcacccaaaatttctgttcttagaaaagaacagatctttttttttctgagattttttttttttttaattagaagagacgctggaagcatgatgacagcagcgtagttttcactctcttgttatgccagcatacagacagagcaaccagatgacaaaatcaaaacccatgggtaatatttacggtgaggccagtagacacagtgtccccagtgtggcagattttctgcagatagggctgccagctgtatttccaaccctgtatgtgtttgccaccctcccatcaagacatggtgcctattttttcatcctttgtgtctgggctggccttgtgttccatttgaccaataaggtatggtagaaatggcattctgggacttctgagcccaaccttaaaagacattgaacttttgctttagtgagaggggaatcaagataccctgtaaagaggtctgtgctgtccttctgaagacagaggtcctggaagatgagacactttttaaaaataggtcatgcagcgctgtggcagccacccagctagctcagttggtagagcatgagactcttaaatataggccatgtacataactgaggccccagctggcrgctagcactgaggtctcagtcgtatcatgaamttatcttgcatcctccagtaccattccagcttctccaggcatcatatagagaagaaacaagtctgggcgtggtggttcacacctgtaatcccagcactttggtaggccgaagcaggcagatcatctgaagcagtgaagcaaggagtttgagaccagcctgggtagcaaagcaagacctcatctctactaaaatatattagtcaggcacagtggcacatgctggtagtcccagctactcaggaggctgaggtgggaggattgctgtgcccaggattttgaggctgcagtgagctatgatcgcactactgtactccaatggtcaacagaacaagatcccacctcttaaaaaaaagaagaagaagaagaaacgagccatccccactgagccatgcccagattcgtgagcaataaaatagttattaatccactaaaaaaaaaaaaaaaaaaaaaaaaaaaaaaaaagggcggccgctttan

SEQ ID NO: 4680 - DNA, 1509 bp, Homo sapiens
  misc_feature (1484)..(1484): n equals a,t,g, or c
  misc_feature (1490)..(1490): n equals a,t,g, or c
  misc_feature (1493)..(1493): n equals a,t,g, or c
  misc_feature (1498)..(1498): n equals a,t,g, or c
actactatagggaaagctggtacgcctgcaggtaccggtccggaattcccgggtcgacccacgcgtccgatcggagcgcggcgtgcgggagggcccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtsggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccaagaagaaaaaaaggggnaaaaanggnaaaangggcccccccc

SEQ ID NO: 4681 - DNA, 1350 bp, Homo sapiens
  misc_feature (1338)..(1338): n equals a,t,g, or c
gctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctygcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttkctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaaaaaaaaaaaaaaaaaaaaaaaaaaaaaanccccgggggggg

SEQ ID NO: 4682 - DNA, 2541 bp, Homo sapiens
gcgtccgggaacgatcacaaggtcatgcacttagatttatgaccaatcatcaagctattaatttactcaaatggtgtattaatttgttaggacggtcataagaaaatactacagatttggtggcttaaacagcagaaatttgttttctcacaattccaaaagctgtgaaatccaaggtcaaggtgtcagcaggtctggcttctccttaggactctggttgtcttgcagatggccaccttctcactgtgttatctcatggcctttcctctgtgcgcaggcatcgctgggatctctgtatgtgtcaaaatttcctgcttttataaggacatcagtcagactggattaaggcccaccctaaaggcttatttaaattttaatctcctctttagtggtcctatccaaatatagtctcattctgagatactggtatttagggcttcagcatacaaattttggggtagacacaattcagcccataacaaattgtgctcatgaaatgatttactaataatgattgtggagagagatagtaatccgactgtgaatcctgaataattagtggcttcatgttcatagaagtggactcaataatgggcatgaacctgcacgagggaggcattgcggagaagaatacgtcccattttctgtaccaaagaaaaacaagtacacattgcaaacaataaatctttatcaaattcaaccaccttattttgaactctataatcattcaaacgtggcctagactaacatttgcttttttatagcttttatcaagaggagtggaggtattaaaattattattgaggggtgtagtgattttcaactgacgcaattctaccctccacctctcatgcaggggacatttggcaatgtctagggactttttttattgtaataagtgggaagtagctgatgatttcaagtaggtaaagatagggatgttaaatctcctataatacacacgacagcctctcacaacaaaaaattatttgacccagaatgtcagtagtgctaaggtgaaaaaaccttatgtgaatcaattaaatcagggagaacttcagagcttttttaagacctttatttatatctagatgattgatattttttaggtattcatgaaaatactttcttttacctttcttgtggtaaccacaagataacactttcttgcctggttaaaaatggacaactgctacacttttaaaataatataaagcgttcagtaattcaaaccatcctgtcttctgatttgtctgaattagtgtggctttactgcattttcagggcttattattctttcagtagggagactactaagatttcattaaagatagctgaataaatgatcaaatacattattgtagctccagactaggtaataaacattgagatatgcttttcaagtagtggtgaaaatactaggcaaaattacacatacacttacatatattaagcgaccatcctgttggcctggtatgtgaagctctgctgaactcttgcctacatgcatggacccatcgattgtgaatgtgtgactacttgtgtgttttcatcataaccagctcatcctaatagcaaatgatatggtttggctgtgtccccacccacatctcatctttaattatagttcccttaatctccacatgctgtgggagggaccctagtagcaggtaattgaatcatgggggcagtttccccatgctgctctcgtgatagtgagtgagtactctgagatctgatggttttataagcatctggcatttcccctgttggcactctttctccttcctgctgccctgtgaagaagatgcctttcttcccctttgctttccaccatgattgtaagtttccagagaccttcccagccatgtggaactgtgagtcagttaaccatcctttctatataaattacccagtattggatatttttcatagcagcatgagaacagacgaatacagcaaagaacacgttttatgaaggaaaaactttgaaaacaaagggactactttctttgatgagaggcccttcctttcactttaaacaaaacttcaaattatcctcagaatttgttctaattctccctacttctgggtaaaaattattagcagtaacagatttaacttgaatgtatatttccagttccccattctcttctctatgtagtgctgccaaactcaatagatttgaaacaaaaattacccagggaccttccccatctcccatgtccttttttcttatggcccagacctggaagtcctcctaagtgcttcctctccctcagcctaacgctctaccactatccagttgcaggtacactcttcctccttcacctcaccctttgatgccatctccactgctaccatcttgggtccaaccctcatgttatcttgcctgaaaaccgctaactttataactagtctctgttctatcaacatcctcttcctgactgtcatccacagatccactttctaaaatgccatcatgacgcttccatgcttataccactagcttttcagtggctaccaaaaaaaaaaaaaaaa

SEQ ID NO: 4683 - DNA, 781 bp, Homo sapiens
gggaacgatcacaaggtcatgcacttagatttatgaccaatcatcaagctattaatttactcaaatggtgtattaatttgttaggacggtcataagaaaatactacagatttggtggcttaaacagcagaaatttgttttctcacaattccaaaagctgtgaaatccaaggtcaaggtgtcagcaggtctggcttctccttaggactctggttgtcttgcagatggccaccttctcactgtgttatctcatggcctttcctctgtgcgcaggcatcgctgggatctctgtatgtgtcaaaatttcctgcttttataaggacatcagtcagactggattaaggcccaccctaaaggcttatttaaattttaatctcctctttagtggtcctatctccaaatatagtctcattctgagatactggtatttagggcttcagcatacaaattttggggtagacacaattcagcccataacaaattgtgctcatgaaatgatttactaataatgattgtggagagagatagtaatccgactgtgaatcctgaataattagtggcttcatgttcatagaagtggactcaataatgggcatgaacctgcacgagggaggcattgcggagaagaatacgtccattttctgtaccaaagaaaaacaagtcccattgcaaaccataaatctttatcaaaattcaacccacccttaatttggaactctataatcattcaaacgtgggcctagactaacattggctttttttatagctttttatcaagaggga

SEQ ID NO: 4684 - DNA, 515 bp, Homo sapiens
  misc_feature (57)..(57): n equals a,t,g, or c
  misc_feature (75)..(75): n equals a,t,g, or c
  misc_feature (85)..(85): n equals a,t,g, or c
aggcccttcctttcactttaaacaaaacttcaaattatcctcaggatttggtcttantctccctacttctgggtnaaaattattngcagttacagattttacttgaatgtatatttccagttccccattctcttctctatgtagtgctgccaaactcaatagatttgaracaaaaattacccagggaccttccccatctcccatgtcctyttttcttatggcccagacctggaagtcctcctaagtgcttcctctccctcagcctaaccgctctaccactatccagttgcaggtacactcttcctccttcacctcaccctttgatgccatctccactgctaccatcttgggtccaaccctcatgttatcttgcctgaaaaccgctaactttataactagtctctgttctatcaacatcctcttcctgactgtcatccacagatccactttctaaaatgccatcatgacgcttccatgcttataccactagcttttcagtggctaccaaaaaaaaa

SEQ ID NO: 4685 - DNA, 550 bp, Homo sapiens
  misc_feature (18)..(18): n equals a,t,g, or c
  misc_feature (528)..(528): n equals a,t,g, or c
gggaacgcttttacgccngcaggtcccggtccggaattcccgggtcgacccacgcgtccggaggtgkkgggcagagtccccakkcagttgggattccggggagggaccacagtgctgggaaccacagcactgacgccatacacaccaggggatgtttgctcttgcatggaaagtgattttcagtgtcatgctgcagaatcccatacgttatccttcagtccttggtataaagtcctccctgctcagtagtcttgtgttggtgatggtttggggaaatgaaaagagtgggccctgccccacaccaaagtccaggaagggaagaaggagctgtccagcacaggtggggaggggagaaraggggtcctattgggacccagaattcagactgagcaggaaatccaaccaggggttgaggagggattacctgagcttgtatcacttcaacctgcattttagagacacattctaatctcacagatgcagaatttggggatccctggacagctaacacttgggggtgcaaatgtncttgttgaatgagaggaactgg

SEQ ID NO: 4686 - DNA, 1724 bp, Homo sapiens
ggcacgaggttttctatgcacatattatgtcatcttcaaacagggaaaatttgacatccttgccctttatttctttctcttgcctgatttctctggccaagacttccagcactatgctgaataaaagtggtgaaggtgggcatatttgttttgttccagttcttagaggaaaagctttcagtgtttccccattttgtatgatggtggctgtggatttttcatgcctatcctttattttgttaggtatacttgttctatatatttattttgttatgtatgcttgttctatacctactttgtttagtgttctttaacatgaagaaatgctgaattttatcaaatgcttttcctgcatttattgagatgattatatggtttttgctattcactctgttgctcttcaataaatatgatgtgatgtcattttttttatttgaatatgtcaaaacatccttgcatccctgggataaatctcaattgatcatagtaaattatctttgtagtgtgctggtggatttgatttcctagtatgtcattgagaattattgcacttctattcatcagcgatattggtctgctgttttcatttcttcttgtgtcccattctggttttggtataagggtaatgctgccttcatagaatgaattaagaagaactctcttttctttgatttttggaacagtttgaaaagaatgggtattaagtattttttttaatgtttggtagaattcagcattgaagccatcaggtcctgggcttttctttgatgagagagtttttattactggttatatttcattacttgtaattagtctgtttagactctctatttctttttggttcaatcttgataggttgtatatgcctgagaaattatacatttttactaggctttccaatttgttgactcatggttgattgtaatagactccaatgattctttgtatttctgtggtatcaattgtcatgtctcctttttcatttctgatttcatttatttgagtctttcttttttcttactttgtttagctaaacatttgttaattttgtttatttttttacaaacaaaactctttgttttattgatcttttgtattttatttttactttcaatttcatttatttttgctctgatcttcattagttcatttttcctactaattttgagtttggtttgcttttgtttttcttgttccttgaggtgcatcattagattgtttatttgaaatattctctacttttttcgatgtaggtgtttattgctataaaattccttcttaatactgcttttgctgtatcccatagcttttgatacattgtgtttatactttcatgtgattcaagaaattttaaatgtacttcctaattttttattaatccattggttgttcaagagcatgttgttaattttgatgtatttgtacagttttgaaagttatttctgttactgatttctagctttaattccttgccatcagaaagtatacttgatgtgatttcagtacttttaaacttgttgagacttgctttgtagcccaatgtgtggtctctccaggagatttttccatgtgctaatgaaaaaaaaatgtgtattctgcagctgttgcatgaactattctgtcaatgtctgttaagtctatttggtctaaagtgaaatttaaatacaatgtatctttgttgaaaaaaaaaaaaaaaaaaaaaaaaaaaaaaaaaaaaaaaaaaa

SEQ ID NO: 4687 - DNA, 251 bp, Homo sapiens
  misc_feature (8)..(8): n equals a,t,g, or c
ctgggctnttaaccctgttsmgacttgctttgtagcccaatgtgtggtctctccaggagatttttccatgtgctaatgaaaaaaaaatgtgtattctgcagctgttgcatgaactattctgtcaatgtctgttaagtctatttggtctaaagtgaaatttaaatacaatgtatctttgttgaaaaaaaaaaaaaaaaaaaaaaaaaaaaaaaaaaaaaaaaaaaaaaaaaaaaaaaaaaaaaaaaactcga

SEQ ID NO: 4688 - DNA, 1075 bp, Homo sapiens
  misc_feature (745)..(745): n equals a,t,g, or c
  misc_feature (984)..(984): n equals a,t,g, or c
  misc_feature (1001)..(1001): n equals a,t,g, or c
  misc_feature (1023)..(1023): n equals a,t,g, or c
  misc_feature (1052)..(1052): n equals a,t,g, or c
  misc_feature (1068)..(1068): n equals a,t,g, or c
ctgttttcatttcttcttgtgtcccattctggttttggtataagggtaatgctgccttcatagaatgaattaagaagaactctcttttctttgatttttggaacagtttgaaaagaatgggtattaagtattttttttaatgtttggtagaattcagcattgaagccatcaggtcctgggcttttctttgatgagagagtttttattactggttatatttcattacttgtaattagtctgtttagactctctatttctttttggttcaatcttgataggttgtatatgcctgagaaattatacatttttactaggctttccaatttgttgactcatggttgattgtaatagactccaatgattctttgtatttctgtggtatcaattgtcatgtctcctttttcatttctgatttcatttatttgagtctttcttttttcttactttgtttagctaaacatttgttaattttgtttatttttttacaaacaaaactctttgttttattgatcttttgtattttatttttactttcaatttcatttatttttgctctgatcttcattagttcatttttcctactaattttgagtttggtttgcttttgtttttcttgktccttgaggtgcatcattagattgtttatttgaaatatttctacttttttcgatgtaggtgtttattgctataaaattccttcttaatactgcttttgctgtatcccatagcttttgatacattgtgnttatactttcatgtgattcaagaaattttaaatgtacttcctaattttttattaatccattggttgttcaagagcatgttgttaattttgatgtatttgtacagttttgaaagttatttctgttactgatttctagctttatttsctyrccatcagaaagtatacttgatgtgatttcagtacttttaaacttgttgagacttgctttgtagcccaatgtgtggcctctccaggagatnttccatgtgctaatganaaaaaaaatgggtattctgcanctgtgcatgaactattctggcaatggccngttaagtctatttggnctaaaag

SEQ ID NO: 4689 - DNA, 1327 bp, Homo sapiens
  misc_feature (5)..(5): n equals a,t,g, or c
  misc_feature (7)..(7): n equals a,t,g, or c
  misc_feature (9)..(10): n equals a,t,g, or c
  misc_feature (1205)..(1205): n equals a,t,g, or c
aaccnangnntaccggtccggaattcccgggtcggacccacgcgtccgcggcgggcgacgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagraatattgagttctaatgttacatctgaggragtatgtaattgagrattgtaacttctaaggggttcactgcatcatrgctatgcctgtatggrgntctwaccatatgaccmataccamcccwtaatcccagctgraccaargrtacckgtaaccattwwggatttgaggggkggcctttcccyggcyttgkttwacccmtccacggagaatctggca

SEQ ID NO: 4690 - DNA, 2755 bp, Homo sapiens
  misc_feature (2)..(2): n equals a,t,g, or c
  misc_feature (5)..(5): n equals a,t,g, or c
  misc_feature (45)..(45): n equals a,t,g, or c
  misc_feature (59)..(59): n equals a,t,g, or c
antgncagaaactaaccctcactaaagggaacaaaagcgtggagnccaccgcggtgcgnccgctctagaactagtggatcccccgggctgcaggaattcggcacgagaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccatggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgcaaaaaaaaaaaaaaaaaaaaaaaaaaaaacccgggggggg

SEQ ID NO: 4691 - DNA, 553 bp, Homo sapiens
gtgtgccggatttggttagctgagcccaccgagaggcgcctgcaggatgaaagctctctgtctcctcctcctccctgtcctggggctgttggtgtctagcaagaccctgtgctccatggaagaagccatcaatgagaggatccaggaggtcgccggctccctaatatttagggcaataagcagcattggcctggagtgccagagcgtcacctccaggggggacctggctacttgcccccgaggcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctgaggtcgcgcgcagtggcaacagcgcgggcggaggcggctccaggtccggagggttgcgggggagctggaaataaacctggagatgatgatgatgatgatgatggaaaaaaaaaaaaaaaaaaaaaaaaaaaaaaaaaaaaaaaaaaaaaaaaaaaaaaaaaaaaaaaaaaaaaaaaaaaaa

SEQ ID NO: 4692 - DNA, 904 bp, Homo sapiens
ggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactakccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgccacctatgtaccaacgagatgacattattagaagcaattctttacctccaatggatgtgatgcactcatctgtctatcagacatctttgcgggaaagatataactcattagatggatattattcggtggcttgtcagccaaagtgagccaaggacaactgtgcctttaccaaggttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagaga

SEQ ID NO: 4693 - DNA, 1652 bp, Homo sapiens
  misc_feature (1640)..(1640): n equals a,t,g, or c
  misc_feature (1644)..(1644): n equals a,t,g, or c
  misc_feature (1648)..(1648): n equals a,t,g, or c
ttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggscctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagcyttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtyagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgaaaaaaaaaaaaaaaagggggccgctctagnggtnccangctt

SEQ ID NO: 4694 - DNA, 2277 bp, Homo sapiens
aattcggcacgagccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacctgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacagagattctggaaaacagaattattcttcataggctttatcatcatgggattcttcttttatatactgattacaagactgacacctatcaagtatgatgctgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagcttgaggctacagtgagccttgattgtgtcactgcactccagcttgggtgacagagaccctgtc

SEQ ID NO: 4695 - DNA, 974 bp, Homo sapiens
  misc_feature (814)..(814): n equals a,t,g, or c
  misc_feature (877)..(877): n equals a,t,g, or c
  misc_feature (901)..(901): n equals a,t,g, or c
  misc_feature (959)..(959): n equals a,t,g, or c
gccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttngggacccktttctaaatacatctgctgcctacattcctgctcacacatacggttgcagctttngagggcagggagagggtagttktngyttccctagggaagagtgtyttccaaagtgttctttcatttttttggcccgcttggnttcttcattgttttt

SEQ ID NO: 4696 - DNA, 2292 bp, Homo sapiens
atgggcgaggctgcggggccccggcgcgcacgcccgcacctctccccagccctggcgtgggcccagcccggcccaggcagcaatggggttcctgcagctgctggtcgtarcggtgctggyatccgaacaccgggtggctggtgcagccgaggtcttcgggaattccagcgarggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagcttgaggctacagtgagccttgattgtgtcactgcactccagcttgggtgacagagaccctgtctcga

SEQ ID NO: 4697 - DNA, 1161 bp, Homo sapiens
ggcacgagtcgtccagcccgcggcgagagcgggtatgtgggcgggaggccggagcagctgtcaggctgaagtcctgcgagcgacgcgcggcggggcggcgagaggaaacgcggcgccgggccgggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcattgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttaaaaaaaaaaaaaaaaaa

SEQ ID NO: 4698 - DNA, 1617 bp, Homo sapiens
ggcacagctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacacatggccaactacccgcagcctgggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggcacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaaaaaaaaaaaaaaaaawctcgaccgcaagggaat

SEQ ID NO: 4699 - DNA, 1820 bp, Homo sapiens
acccacgcgtccggccgggcgcgggtcgtggtgcaccacgggagcgccgcaccggccggcatggaggagcgcggcgattccgagccgacccccggctgcagcggcctgggtccggrcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctaacccccatcactgcttccctcagccataacagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaaaaaaaaaaaaaaaaactcga

SEQ ID NO: 4700 - DNA, 2209 bp, Homo sapiens
ggacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgacttttaaaaaaaaaaaaaaaaaaaaaaaaa

SEQ ID NO: 4701 - DNA, 1153 bp, Homo sapiens
  misc_feature (709)..(709): n equals a,t,g, or c
cccacgcgtccgtccacggtccgcccacggtccgagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaawaaaaaaaaaaaaaaaaaaaaacycgagggggggcccggtacccaattcgccctatagtgagncgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactycaacgkcaaagggcgaaaaaccgtctatcagggcgatggcccactacgtgaaccatcaccctaatcaagttttttggggtcgaggtgccgtaaag

SEQ ID NO: 4702 - DNA, 535 bp, Homo sapiens
  misc_feature (400)..(400): n equals a,t,g, or c
  misc_feature (463)..(464): n equals a,t,g, or c
tttctgttcttgcgatagttcgctkagartgatggtttccagcttcatccatgtcccyrcaaaggacatgaactcatcmttttttatggctgcatagtattccatggtgtatatgtgccacattttcttaatctagtctgtcattgttggacatttggcttggttccaagtctttgctattgtgaatagtgccacaataaacatatgtgtgcatgctcacacagatactttttaacaacatgaccactttctaagttcattaccctttgaaacaaaataaaacaaaactcagctacaccatttctaaacaaaggtgtaaaaaaaaaattgaagrtccagttagctaaggragscactaaaagagttggaacaaaaggctctctccaaatggctatgaatntaagcctttataattcataaagaacatatgaattcaggaagaaaaatgtgcagtttatagttnnatatagcattaacctggaaattgctctcagatcttaaaaatctccaactctctgttacttttacatatgaa

SEQ ID NO: 4703 - DNA, 343 bp, Homo sapiens
  misc_feature (18)..(18): n equals a,t,g, or c
  misc_feature (31)..(31): n equals a,t,g, or c
acctatgaatgagacatncggtgtttggttntctgtccttggtgatagtttgctgagaatgatggtttccagcttcattcgtgtccctgcaaaagatatgaactcatcctattttatagctgcatagtattccatggtgtatatgkgccacattttcttaatccagtctatcattgatggrcatttgggttggttccaagtctttgctattgtgaacagtgccacagtaaacatacgtgtgcatgtgtccttatggtagaatgatttataatcctttgggtatatacccagtaatgggattgctgaatcaaatggtatttctagttctagatccttgaggaat

SEQ ID NO: 4704 - DNA, 921 bp, Homo sapiens
ggcacgagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcagttgcaaatattgacaagtttgaagagaagcttcgagcagctgaagatgagctgaatatcgaggccaaggacaggatcccagtttcctacaagcgaacaggattctttgggaaatgccctgtactctgtggggatgacggtagtgggcctggccatcctgtggtatgttttccgtctggccgggatgactggaggcaccgccggcgatggacgtccatgtcccggctcctgtgctggaaagcgttgatggggagcgtcggcgctgaccacacgcgggagctgcggaagcccagcggttcacacaggcctcccttcaacgtagtcatcccctggtggtggaagcaagacgacggcccctgacgtgcagccacacacagaaaaggctgctgtgaacattttatgcttcgactttttttttcttcagagacagggtgtcgttctgtcgcccaggctggagtgcagtgccaccatcatagctcactgcagcctccacctcctaggctcaagcttcctaagtagttgggactcaaggcttgagtcaccatgccaggctctgttttttcagtctgtgaaaaataaagtcatcagcatgtgaaaaaaaaaaaaaaaaaaaaaaaaaaaaaaaaaaaaaaaaaaaaaaaaaaaaaaaaaaaaa

SEQ ID NO: 4705 - DNA, 480 bp, Homo sapiens
  misc_feature (437)..(437): n equals a,t,g, or c
  misc_feature (460)..(460): n equals a,t,g, or c
  misc_feature (477)..(477): n equals a,t,g, or c
  misc_feature (480)..(480): n equals a,t,g, or c
tcgacccacgcgtccggcgcgaggagcagccgctgccgccgctcggggtcgcctggagccccagattcccgagcgctcggctcgcatggcagccgcttcggcgcccggccccgcggccagctaggggcggccccgcgctccctcacggcccctcggcggcgcccgtcggatccggcctctctctgcgccccggggcgcgccacctccccgccggaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagtcccactgtgacctggcccacggctgctgtgaactgacggctcctgcagtgtgaccgggttggaagggtgcactgtnagcgctgtgtgaggatgctgctnccagcacggtaactgcnaan

SEQ ID NO: 4706 - DNA, 1841 bp, Homo sapiens
  misc_feature (11)..(11): n equals a,t,g, or c
  misc_feature (21)..(21): n equals a,t,g, or c
  misc_feature (61)..(61): n equals a,t,g, or c
  misc_feature (65)..(66): n equals a,t,g, or c
  misc_feature (571)..(571): n equals a,t,g, or c
  misc_feature (1839)..(1839): n equals a,t,g, or c
  misc_feature (1841)..(1841): n equals a,t,g, or c
tcattccttcngtgcccctcncggctcctgcaggtgtgacccgggctgggaggggctgcantgtnngcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtkccagccgcccatgccagagaggggcccgntgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggwggygcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaagtgggctcctatgccagaaaaacccacctggcgttccagatgcaagagggccagagcagaggcctggttctggggaagcctcaggatgctgcccaccaaggagtgatttccaaagagtaatccagggtgcccttttcccttctggggaagtgtggagaggtagagccccagaggagaatgtaaacaagcagccagcacctctgtataggcccggcctggatcagagagaggggagaactctgcagggtgtgggattgggctcagggacctccgagtgaggcagggactccctgctggctgctctgcagcagctgctggaacagggagtggggctggttgcgcagggtggccggggagtccagctctaccactctccccgcttgtagcaccagcacccggtctgagttcaggatcgtgttgagcctatgggcaatggtcagcactgtcttgttggcaaagcgtttgcagatggtctgctggagcagctggtctgtcttctggtccacacttgctgtggcctcatcgatacacaggatcttggcatctgtgaggagagccctggccaaacacaacagctgcctctgcccaagagataagctccggcccncn

SEQ ID NO: 4707 - DNA, 2317 bp, Homo sapiens
  misc_feature (1419)..(1419): n equals a,t,g, or c
  misc_feature (2165)..(2165): n equals a,t,g, or c
cctgcagctaccgtccgcaattcccggtcgacccacgcgtccgggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaakggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctsagctgtyyywaaaagaagctgaaaatgccaagcgagagggtgaaactagaattcgacgaaatgctgaaaaggatttttgcaaggaatwtgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacaatcctatccagggcccagatgggaaagtgcatggcaacacctgctccatgtgtgaggtcttcttccaagcagaagaagaagaaaagaaaaagaaggaaggtwmmtcaagaaacaaaagacaatctaagagtacagcttcctttgwkgagttgtgtagtgaatmccgcaaatccaggaaaaacggacggcttttttgcnccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaaaaaaaaaaaaaaaaaaaaaaaaaaaaaaaagggcggccgctctagaggatccctcgaggggcccaagcttacgcgtgcatgcgacgtcatagctctctccctatagtgagtcgtattataagctaggcactggccgtcgttttacaacgtcgtgactgggagatctgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggktttactngcyttaaaaaacctcccacacctccccctgaacckgaaacataaaatggaakgcaatggtggtggtaactggttaatgcagccttaataaatgggttaccaaattaaaggccaataggccatccaccmaaaattttccacccaaattaaaag

SEQ ID NO: 4708 - DNA, 2755 bp, Homo sapiens
  misc_feature (953)..(953): n equals a,t,g, or c
agagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtggtgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagctggatgggtggaggcttaggtagccggacctgcctgccaccctcctctyccactcaggcacaatggtgctaaaagtgtttccaatctctgggacctctgtacccaaactgaaactctaaattggggccctaactaattttccttttgaggttgtgggcataagtsctgatctagaatacagtctgggtsncacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcagcttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgcctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaaaaaaaaaaaaaaaaaaaaaaaaaaaaaaa

SEQ ID NO: 4709 - DNA, 464 bp, Homo sapiens
  misc_feature (439)..(439): n equals a,t,g, or c
gccaatgttgaaagacttttcaaatctattgttggtggtactctgtgactatgttcttggagaagctgaatatcttctcttgagagagccaggccatgtagcactaagcaacgacacagtgtatgtggatttccagtattttgatggkgctaatgggacactgaggaatgtatctgtcctgctgttggaggccaacaccaatcagactgtaactaccaagtacctcctgaccaaccagtcccagggaacactaaagtttgagtgcttctatttcaaggaggctggtgactactggttcacaatgactccagaagcaacagacaacagcactccattcccctggtgggagaaaagtgcctttctgaaggtggaatggcctgtctttcacgttgacttgaataggagtgccaaggcagcagaaggcaccttccaagtgggnctatttaccagtcaaccactgtgcc

SEQ ID NO: 4710 - DNA, 729 bp, Homo sapiens
ggcacgaggtcgaggtgcccacctgtttcctgaaaaactggagcatttccaagrggcaagtggaacccgtggtccattaaaccctctccctaaatcctacactttggggcagcccttgaggaaaccagaccttggggatcrccaggcaggattagtggcmggaattgagagaacagagccccacagagctcstcggggaccgtcccccagtcacaagagtatctcaaggaagtagtcttctcccacatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagcttaacacagctggggtctgctactcgcgttttgtagacttttgtgtaactatttgtaccgtaggacagaatgtgaggaggaagtaacacacacagaggaggatgtgtgtgtgtgcatgtgtttgaattcacaaggaagaaattatttatcttgagctttttcctttgttattcagtttttattggtttattactaataatgataataaaatgtaaawgagcaaaaaaaaaaaaaaaaa

SEQ ID NO: 4711 - DNA, 1708 bp, Homo sapiens
  misc_feature (85)..(85): n equals a,t,g, or c
  misc_feature (254)..(254): n equals a,t,g, or c
  misc_feature (256)..(256): n equals a,t,g, or c
  misc_feature (423)..(424): n equals a,t,g, or c
ctcgtgcgaattcggcagagctctgggccaatatggcagcgcccagcaacaagacagagctggcctggagtccgcggctggccgngtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcactncncatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggasacagcgtgcgtaannggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacrggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaaaaaaaaaaaaaaaaagggcggccgc

SEQ ID NO: 4712 - DNA, 1861 bp, Homo sapiens
  misc_feature (1255)..(1255): n equals a,t,g, or c
  misc_feature (1412)..(1412): n equals a,t,g, or c
agctctgctcctcagtcttctccctgtctgaagaggagctgctcaggatgaggcaggaggtccatggctgctttgctcagatggacaggagcttggccctccccaagatccgggcccgagttctgctgcagcaatttcagactgcgtggcgagaagcagagttcgtgaagctggaccaggccgtggctgcccctgagctgcagcaacagtccaaggtgagaaagtcacggtccaagagtaaaagcaagggagagcttctgaagaagtgcatcgaagacaaaattcacctctgtgaggaacaggcctctgaagacctggtggaaaaggttcgaggtgaattgctgcgggagagagtgcagcggatggaggcacaggagggaggctttgcacagtcgcttgttgctctgcagttccagaaggcgtcccgggtgaccgagactctgtcggcctacaccgccctcctcagcatccaggacttgctcctggaagagctgagtgcatctgagatgctgaccaagtcggcctgcacacagatcctggagtcgcacagccgggagctccaggagttggagaggaagctggaggaccagctggtgcagcaggaggcagcccagcagcagcaggccctggcgagctggcagcagtgggtggccgatgggcccgggattctgaacgaacctggggaggtggattctgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccatgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagagcatattaaagaagacatgtctccctctcagagagaggatgatattctctggaaaaggaagttggccacacctgtcactggagcccattggsgaactggnccctgtacccattgtaggggcagaaaccattgatctattaaacacaggagagaagctctttatattcagaaatccaaaggagccagagatctcactgcacgttcctcccaggaaaaagaagaactttttgaatgccaaaaaggccatgagggccttnggcatggactagcccaagggaaagacctgcgggascatctgaagagagaagggatgattttctcctgcccgccggtgtttgtgtgtttataatgcacaactcgcaaatataaattgcacatgcagaaggcacagaccccgtagcgcatgccaacttgcagggactcggtttaatcttgtctcatgaatttccagatggcccactctcttccatatcacaaggacataaacactccttctttcagccccacctccccagggccctggaggagacccccaccctgcaatccacaccccatcctctgctgcagaagctatggtctgtgtggtgacagccagattctctactcttatgttttgtatttgttacatattctatttttataaagggaatttaaaaaaataaatgtgttttgcacaaaaataaaaaaaaaaaaaaaaaaaaaaaaa

SEQ ID NO: 4713 - DNA, 1362 bp, Homo sapiens
tcgacccacgcgtccggggatctggggtcaggcagcccggggggcttggagagacttccagaggaggcgcggactcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagcatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggcccgggcagagccgggccgcccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttcaaaaaaaaaaaaaaaaaaaaaaaaaaaaaaaaaaaaaaaaaaaaaaaaaagggcggcc

SEQ ID NO: 4714 - DNA, 888 bp, Homo sapiens
  misc_feature (17)..(17): n equals a,t,g, or c
  misc_feature (887)..(888): n equals a,t,g, or c
ggggggctggcaggganttcggcacgagctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatrgagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtccggaann

SEQ ID NO: 4715 - DNA, 856 bp, Homo sapiens
tcgacccacgcgtccgcccacgcgtccgatcagctgctctgaagctccatggtgcccagaatcttcgactcagaagggaccatagatattggactgtggttgtgccagttgacactcaggagtggagactagatctgcaatctgttgggactgtgatgaggggatcatcctgccctcgaaccagacccagccctgtagcccaggcactattgcctggagttcctgggctctcagcgccaggaaatcatgaggttcagtgtctcaggcatgaggaccgactaccccaggartstkcgctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctagggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtacacacctgtaaaaaaaaa

SEQ ID NO: 4716 - DNA, 1441 bp, Homo sapiens
  misc_feature (1436)..(1436): n equals a,t,g, or c
  misc_feature (1438)..(1438): n equals a,t,g, or c
ccacgcgtccggaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgcagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaananaaa

SEQ ID NO: 4717 - DNA, 1441 bp, Homo sapiens; identical to SEQ ID NO: 4716
  misc_feature (1436)..(1436): n equals a,t,g, or c
  misc_feature (1438)..(1438): n equals a,t,g, or c

SEQ ID NO: 4718 - DNA, 695 bp, Homo sapiens
  misc_feature (11)..(11): n equals a,t,g, or c
  misc_feature (683)..(683): n equals a,t,g, or c
  misc_feature (685)..(685): n equals a,t,g, or c
  misc_feature (693)..(693): n equals a,t,g, or c
acacacgctcngcaggtaccggtccggaattcccgggtcgacccacgcgtccgttgakgccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccaaaaaaaaaaaaaaaaaaaaaccncngggggggncc

SEQ ID NO: 4719 - DNA, 789 bp, Homo sapiens
  misc_feature (32)..(32): n equals a,t,g, or c
  misc_feature (61)..(61): n equals a,t,g, or c
  misc_feature (78)..(78): n equals a,t,g, or c
  misc_feature (87)..(87): n equals a,t,g, or c
  misc_feature (92)..(92): n equals a,t,g, or c
  misc_feature (752)..(752): n equals a,t,g, or c
  misc_feature (784)..(784): n equals a,t,g, or c
acggattaacaatttcacacaggaaacagctnttgaccactaggctttttgcaaaaagctnttttaggtgcccctttnagaggtacncctgnaggtaccggtccggaattcccgggtcgacccacgcgtccggctgctctgaagctccatggtgcccagaatcttcgctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctagggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtaaaaaaaaaaaaaaaaaaaaaaaaaaaaggggggccgccytaangggtcccccgaggggcccaaagtttaggggtncaatg

SEQ ID NO: 4720 - DNA, 2260 bp, Homo sapiens
  misc_feature (2225)..(2225): n equals a,t,g, or c
  misc_feature (2234)..(2234): n equals a,t,g, or c
  misc_feature (2253)..(2254): n equals a,t,g, or c
cccacgcgtccggaggaacagacttacctcagcaaccctggcacctccaacccgacacatgctactgctgctgctactgctgccacccctgctctgtgggagagtgggggctaaggaacagaaggattacctgctgacaatgcagaagtccgtgacggtgcaggagggcctgtgtgtctctgtgctttgctccttctcctacccccaaaatggctggactgcctccgatccagttcatggctactggttccgggcaggggaccatgtaagccggaacattccagtggccacaaacaacccagctcgagcagtgcaggaggagactcgggaccgattccacctccttggggacccacagaacaaggattgtaccctgagcatcagagacaccagagagagtgatgcagggacatacgtcttttgtgtagagagaggaaatatgaaatggaattataaatatgaccagctctctgtgaatgtgacagcgtcccaggacctactgtcaagatacaggctggaggtgccagagtcggtgactgtgcaggagggtctgtgtgtctctgtgccctgcagtgtcctttacccccattacaactggactgcctctagccctgtttatggatcctggttcaaggaaggggccgatataccatgggatattccagtggccacaaacaccccaagtggaaaagtgcaagaggatacccacggtcgattcctcctccttggggacccacagaccaacaactgctccctgagcatcagagatgccaggaagggggattcagggaagtactacttccaggtggagagaggaagcaggaaatggaactacatatatgacaagctctctgtgcatgtgacagccctgactcacatgcccaccttctccatcccggggaccctggagtctggccaccccaggaacctgacctgctctgtgccctgggcctgtgaacaggggacgccccccacgatcacctggatgggggcctccgtgtcctccctggaccccactatcactcgctcctcgatgctcagcctcatcccacagccccaggaccatggcaccagcctcacctgtcaggtgaccttgcctggggccggcgtgaccatgaccagggctgtccgactcaacatatcctatcctcctcagaacttgaccatgactgtcttccaaggagatggcacagcatccacaaccttgaggaatggctcggccctttcagtcctggagggccagtccctgcaccttgtctgtgctgtcgacagcaatccccctgccaggctgagctggacctgggggagcctgaccctgagcccctcacagtcctcgaaccttggggtgctggagctgcctcgagtgcatgtgaaggatgaaggggaattcacctgccgagctcagaaccctctaggctcccagcacatttccctgagcctctccctgcaaaacgagtacacaggcaaaatgaggcctatatcaggagtgacgctaggggcattcgggggagctggagccacagccctggtcttcctgtacttctgcatcatcttcgttgtagtgaggtcctgcaggaagaaatcggcaaggccagcagtggcgtgggggatacaggcatggaggacgcaaacgctgtcaggggctcagcctctcagggacccctgattgaatccccggcagatgacagccccccacaccatgctccgccagccctggccaccccctccccagaggaaggagagatccagtatgcatccctcagcttccacaaagcgaggcctcagtacccacaggaacaggaggccatcggctatgagtactccgagatcaacatccccaagtgagaaactgcagagactcaggcctgtttgagggctcacgacccctgcagcaaagaagcccgagactgattcctttagaattaacagccctccatgctgtgcaacaggacatcagaacttattcctcttgtcaaactgaaaatgcgtgcctgatgaccaaactctccctttctccatccaatcggtccacactccccgcccccggcctctggtacccaccattctcttctctacttctctgaggtcgactattttaggttccaaatatagtgagatcgtagagtgaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaanaaaaaaaanaatttaaaaaaaaaaaaannaaaaaa

SEQ ID NO: 4721 - DNA, 2139 bp, Homo sapiens
ggaggaacagacttacctcagcaaccctggcacctccaacccgacacatgctactgctgctgctactgctgccacccctgctctgtgggagagtgggggctaaggaacagaaggattacctgctgacaatgcagaagtccgtgacggtgcaggagggcctgtgtgtctctgtgctttgctccttctcctacccccaaaatggctggactgcctccgatccagttcatggctactggttccgggcaggggaccatgtaagccggaacattccagtggccacaaacaacccagctcgagcagtgcaggaggagactcgggaccgattccacctccttggggacccacagaacaaggattgtaccctgagcatcagagacaccagagagagtgatgcagggacatacgtcttttgtgtagagagaggaaatatgaaatggaattataaatatgaccagctctctgtgaatgtgacagcgtcccaggacctactgtcaagatacaggctggaggtgccagagtcggtgactgtgcaggagggtctgtgtgtctctgtgccctgcagtgtcctttacccccattacaactggactgcctctagccctgtttatggatcctggttcaaggaaggggccgatataccatgggatattccagtggccacaaacaccccaagtggaaaagtgcaagaggatacccacggtcgattcctcctccttggggacccacagaccaacaactgctccctgagcatcagagatgccaggaagggggattcagggaagtactacttccaggtggagagaggaagcaggaaatggaactacatatatgacaagctctctgtgcatgtgacagccctgactcacatgcccaccttctccatcccggggaccctggagtctggccaccccaggaacctgacctgctctgtgccctgggcctgtgaacaggggacgccccccacgatcacctggatgggggcctccgtgtcctccctggaccccactatcactcgctcctcgatgctcagcctcatcccacagccccaggaccatggcaccagcctcacctgtcaggtgaccttgcctggggccggcgtgaccatgaccagggctgtccgactcaacatatcctatcctcctcagaacttgaccatgactgtcttccaaggagatggcacagcatccacaaccttgaggaatggctcggccctttcagtcctggagggccagtccctgcaccttgtctgtgctgtcgacagcaatccccctgccaggctgagctggacctgggggagcctgaccctgagcccctcacagtcctcgaaccttggggtgctggagctgcctcgagtgcatgtgaaggatgaaggggaattcacctgccgagctcagaaccctctaggctcccagcacatttccctgagcctctccctgcaaaacgagtacacaggcaaaatgaggcctatatcaggagtgacgctaggggcattcgggggagctggagccacagccctggtcttcctgtacttctgcatcatcttcgttgtagtgaggtcctgcaggaagaaatcggcaaggccagcagtgggcgtgggggatacaggcatggaggacgcaaacgctgtcaggggctcagcctctcagggacccctgattgaatccccggcagatgacagccccccacaccatgctccgccagccctggccaccccctccccagaggaaggagagatccagtatgcatccctcagcttccacaaagcgaggcctcagtacccacaggaacaggaggccatcggctatgagtactccgagatcaacatccccaagtgagaaactgcagagactcaggcctgtttgagggctcacgacccctgcagcaaagaagcccgagactgattcctttagaattaacagccctccatgctgtgcaacaggacatcagaacttattcctcttgtcaaactgaaaatgcgtgcctgatgaccaaactctccctttctccatccaatcggtccacactccccgcccccggcctctggtacccaccattctcttctctacttctctgaggtcgactattttaggttccaaatatagtgagatcgtagagtgaaaaaaaaaaaaaaaaaaaaaa

SEQ ID NO: 4722 - DNA, 1694 bp, Homo sapiens
ccacgcgtccgggataaactatttatcataaatttaaatgttgttattgtgcctttattgcacattttttctcatgccttttattataaaatatacttgttttcaccttgtttttggtcaaatcccagttactgtccatgtaaacatatggcaacataagaacgtcactttttttatcctgcactgtggcatacctgctcttacaagagattctgctgcacttacatattcaaatgatggcacagttatagagactttattattcttaattctttatttagacttaaacattatttgttgctaattaaaacagttcatatgatgaactttataataaaatatatatttttcaggccaggcatagtggctcatgtctgtaatcccagcactccaggagtctgaggcaggcggaccacttgagcccaagagtttgagaccagcctggacaacatagggaggtcctgtctccacaaaaaatttttaaaaaattagctaggcattgtggtgcattcttgtggtcccagctactccggaggctgaggtaggaggaccacttgagccccagaggtcaagggcgcagtaagttgtgagagtgagactctgtctcaatgataataatcataatcataataaagatatgtaccccagagtcaagaatgcaataagctgtgagagtgagaccctgtctcaatgatcttaataatagtcacaataaagatatatattttgcatcagtctgtgggtaattgaatgatgattgctggagtaaaactgagcagaatggtacagtgctgtactgtacagtacataagaatcaggagaggcagctgttttaagccccagtcttattatgcccatttaatcaaggcatgctggctcctgtcatgaattattctgatgttgagtaaaactgtcatcttcaattcatatcactttcaaatgttacattataagagaaatgtaacctggtaagtactaagttgtagattgttacagagtcagaaaagttggatgtaattgctgatattgattatggtaagtagtctttccttgctaaaggaatgccaatttttaaacaaattataaagcaatcatttttacacaaagatgaaaatacacatgggtcctcatatgctaaaatgttatatgtataggtttaaatatctaatttggaaaagctagacatataaataggttttcatccttgcagctaccaatatcaaactatacagttcttgttagtacctcctctagggtgtttggagagggggcagagaaaagagctcaaattcaagttgtttttatatctgacataattttttaaaattataagtcaaatgtttgttaagggaggggatttaagttattaattaaaataagatttttagatcttcagattttacttatctatcctaccttccattgttattgagagttggctgtattttcttttttttttactccctggcctgatttaaagatactctggaacattccagaggcactgaatttatcattctaaaagggccatgtagtactcccaggaggcatagagctgagccactcaatgtgtcttgaggttccaaaattctgattctatgcttttatgaacatgtaatttagcagatgttacctaatagcaaaagaaaatgctatctttaccagaatgcacttaggaaaaaaaaaaaaaaaaa

SEQ ID NO: 4723 - DNA, 1205 bp, Homo sapiens
cccacgcgtccgcagaggcagggcaatagtggagttctggcttggccaagcagcctagaactcaaagtccatggccccttctgggcctggagaaattggatggttatagcaccaggcagcccttgtgggtgggggacagcaaatgagggacctctcttttctctacactctcctttggctcccggagatctggcaggccctggctggaggcataagattagatgaggttgagctgttggagaatgaagctgtgttgggagaagaaatgaggttgtaccggaagatcaacgaggttgtgctgtcagggaatgaggtggtacttgggggcaagtgaggctgcattattagataaatgaggttgtactgtcaggggatgaagtgtacttgtagtagagatgacgtcctgctggatcagtcggcttttgctccatcagagaacacagccacaccacaggaggaaggagagtgtccgactcagaggataaatgagggtgtcctgctggataaatgagggggcccgtcaggtgaatggagtgctgttagcaaatgaggttgtacttgctggataaatgggactggtgtgctggataaatggggttgtgctgtcaggtgaatgcattactgctcgtgggtgaagggcatcctgggaataatgagggtgtcctgctggatagatgagctgccaccaccaaatggatcagaccctgtccatgaaggaggcaccatcagcaacgacgaggttatcctgttcccactggggctcctggagcgtcttctggcccaggggaaactcggtgtgtgccaccctgggttatccaagtctctctggggagcagggtggggggctggggagggcaggcagctgcattgtgcaccgtgggacctctccttcacccccaatggatgccctactcctctccctggcacccctcagtgggtcagactgcttcggacattctcaccccactgcctgcttctcatcctgcctgtgtcttctttctgcccagtttggaaaagcccctattatgtgtcagccactctgcccagtcttatttaatctccctataacacagtattactcctccttgcacatacacactttctcttattcattcatccattcattcatttgacaaacatttaagtgtctagtatgtaccaaacacatgaggtacagttttaaaaagaataaaaaaaaaaaaaaa

SEQ ID NO: 4724 - DNA, 1346 bp, Homo sapiens
  misc_feature (637)..(637): n equals a,t,g, or c
  misc_feature (850)..(850): n equals a,t,g, or c
ggtcgacccacgcgtccgctgagagtagccatgggctctggaggagacagcctcctggggggcaggggttccctgcctctgctgctcctgctcatcatgggaggcatggctcaggactccccgccccagatcttagtccacccccaggaccagctgttccagggccctggccctgccaggatgagctgccgagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaanggacctacatgtgtgtggccaccaacagcgcaggacacagggagagccgcgcagcccgggtttccatccaggagccccaggactacacggagcctgtggagcttctggctgtgcgaattcagctggaaaatgtgacactsctgaacccggatcctgcagarggccccaagcctagaccggcggtgtggctcarctggaargtcagtggccctntgcgcctgcccaatcttacacggccttgttcaggacccagactgccccgggaggccagggagctccgtgggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccaaaaaaaaaaaaaaaaaaagggcggcc

SEQ ID NO: 4725 - DNA, 1402 bp, Homo sapiens
tatcagctcaagccttacaccayccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccatgggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttwttttttttttttttttttttttttttttttggtagttgataataagcgaaggctttaaaattttttatttgaaagaatttgttaaattctactatgggtcttggaaataacccatagtagaatttaaaactaagagcatactttccaaaatatggtctgaagaaaacctctatcatatggcaaatgaagcaaactgagaaagcatgaaaatagaaatcacagaataagaatgatttgcacacaccaagagtttgagaaacatgctctaatgatggaggctggcttaataagatttggggttttcaatgctatagaattcgatatcaagcttatcgataccgtcgacctcgag

SEQ ID NO: 4726 - DNA, 2959 bp, Homo sapiens
  misc_feature (1)..(1): n equals a,t,g, or c
  misc_feature (7)..(7): n equals a,t,g, or c
  misc_feature (15)..(15): n equals a,t,g, or c
  misc_feature (21)..(21): n equals a,t,g, or c
  misc_feature (24)..(24): n equals a,t,g, or c
  misc_feature (1887)..(1887): n equals a,t,g, or c
  misc_feature (1983)..(1983): n equals a,t,g, or c
  misc_feature (1989)..(1989): n equals a,t,g, or c
nctatanatcatacnggaaanggnagactgcagtacggtcggaatcccgggtcgacccacgcgtccggtgggaatgaatgaagttaggagttgaacttaacatccttttgatatgggctttggagtcttacctgttgccctgcaatgaagtagaaactgatgctgccatgcactgactccagcagatacatagcgttgtgtgctgggaggagaggctggaatggattatcccaaggtcccttcaacctaagatggccctaaggaataatggtgctgccactggcctccacctgccacatgcatgggtgccatcgcctatttcaaactctcctcccagtactgaagtcttcctggctctctgtgccaggcttagctgtgcccttggttatggcagttttcttaatttcttcaagttattttcttctgtgtgtctttaccattagatccctgagggcatgggtcttgccgtttacctctgtccctagagctcaaggcggttcttgctgtcggtctcagtggttatataagaccctccctccttgkttggtctgtaaacctgtgtaggacagacgtctgcatctaatggtggcattgggttcacaggagacaggcccatctgagggatgtggatggcataggctgtactttgtggcccaaggttgtccccaaccaagtcaaccaaggtggmttctctggtgcagatttgcgggcagtggtttgtcatttctttcctgtctctgtgactcactccttgttttgtagagctgttctttaaaatcccttgagtgtattaatactttccatttcattgttcatttggcgaaaatcattcttaataagtacattctcaagtgcagtgcccagtgtttgkttttcttgcacattcttagagcctaattttgcagcttacaaaattgtataaatctgtctgtataatacacgtggaacattcctctggatttattggcaaggaaggttgaagcccaggtttggaatccgcaaactaaattttaaccctagctttggctttttattttcttttaagcagacttttttcccttagaaaagtaattcatgattattatagaagcataaagaataaggtagaagaagatctatccagaataaaccacttttaacatttttgtattcttttctatgcagatttttaaaaactattatcttaaaatagytaagataattattattgtctgtagctttgccataagattataactaaattttctataaaaattaaatggggagctttggtttcagtggttacataacawttcatcawttaactgkgccmtaatttaaaccattctcctgcagttggacattaagawtgkttccaactttttactttcataaataagtctgkgatgaacaattttgktcctcttacctgkgtacctggtaagtctttgttatagatgtcaaaaaatagaatgaaagggtattgatatggtttgtctgtgtccctacccaaatctcatcttgaattgtaacttctacaattsccacatgtcatgggaggaaccctatgggaggtggttgaattatgggggtgggattttgctgtgctggtctcgtgatagtaagtctcacgagatctgatggttttaaaaatgggagtttccctgcacaagctcccttctcttgtctgctgccatgtgagacctgcctttcaccttctgccatgattgtgaggcctccctagccacatggaactgtgagtccagtaaacctctttcttttgtaaattgcccagtcttaggtatgtctttatcaagcagcgtgaaaacgaactaatacagggatcaactgtgtaaagctcctatgtgtgctgacagattgctttccagaaagttggtaacaatttgntcacatgtcatggctgagaatgctactttcattctcctctgtgcggcaaaaattgtttgcaaaatcttagtcagtgtgataggtgagcagttgtgnyttggntttcttactagggaaaggtgagcattttccttcattttttgtagaaggctgaaaaacacaaaaaaaactatccatccaaaatgctaccactgaaaagaagytctggaaatgtagaggtaaatgtctaacctagttctgcttccacacttcagaggcagacacagtgaacaggatcctgcttccccagccatttcctagtgcttatgcatcataaacacatttgtgttttctaaaaccaaaatggaaagaggagacacaaggtagtctataattcaccttttctaaaaacattattttatgatggaatattttagacgagctcttcgtggtttttttttttttttgctttgcatttgtttcatgaatttatatttcatgtcctttgcccatttttcttttgaatgttttattctctgtaagagcactttctgygttaaagatatcaactctatcaaatattgkgtatcagagatttttcttagtttgctaagaaactaagcaaacttagttattgcttatttgattttacttatacacagygagtggctttaagaatgacttttgcagtaagtttgtgatttctcttctttgatttcttcctttgcttttagtaaagcttaggaaatgtttctccacactgccatctgtgaaatcatcacctctatcagagagatcagcaaacgtaactagttcaaatagttcagtgacgcaggagaatctcttgaacccaggagttcaagaccagtctgggcaacacagcaagaccccatctctgcagaaaataaaaaaaaaatagctgggcatggtggcacttgcctgtagtgtcagctactcaggaggctgaggtaggcggttgcttgagcctgggaggttgaggcagcagtgaacaatgattgcctcactgcactctagcctgagcaacagagcaagaccctgtctccaaaaaaaaaaaaaaaaaaagggcggccgc

SEQ ID NO: 4727 - DNA, 2894 bp, Homo sapiens
ccacgcgtccggtgggaatgaatgaagttaggagttgaacttaacatccttttgatatgggctttggagtcttacctgttgccctgcaatgaagtagaaactgatgctgccatgcactgactccagcagatacatagcgttgtgtgctgggaggagaggctggaatggattatcccaaggtcccttcaacctaagatggccctaaggaataatggtgctgccactggcctccacctgccacatgcatgggtgccatcgcctatttcaaactctcctcccagtactgaagtcttcctggctctctgtgccaggcttagctgtgcccttggttatggcagttttcttaatttcttcaagttattttcttctgtgtgtctttaccattagatccctgagggcatgggtcttgccgtttacctctgtccctagagctcaaggcggttcttgctgtcggtctcagtggttatataagaccctccctccttgtttggtctgtaaacctgtgtaggacagacgtctgcatctaatggtggcattgggttcacaggagacaggcccatctgagggatgtggatggcataggctgtactttgtggcccaaggttgtccccaaccaagtcaaccaaggtggattctctggtgcagatttgcgggcagtggtttgtcatttctttcctgtctctgtgactcactccttgttttgtagagctgttctttaaaatcccttgagtgtattaatactttccatttcattgttcatttggcgaaaatcattcttaataagtacattctcaagtgcagtgcccagtgtttgtttttcttgcacattcttagagcctaattttgcagcttacaaaattgtataaatctgtctgtataatacacgtggaacattcctctggatttattggcaaggaaggttgaagcccaggtttggaatccgcaaactaaattttaaccctagctttggctttttattttcttttaagcagacttttttcccttagaaaagtaattcatgattattatagaagcataaagaataaggtagaagaagatctatccagaataaaccacttttaacatttttgtattcttttctatgcagatttttaaaaactattatcttaaaatagttaagataattattattgtctgtagctttgccataagattataactaaattttctataaaaattaaatggggagctttggtttcagtggttacataacatttcatcatttaactgtgccataatttaaaccattctcctgcagttggacattaagattgtttccaactttttactttcataaataagtctgtgatgaacaattttgttcctcttacctgtgtacctggtaagtctttgttatagatgtcaaaaaatagaatgaaagggtattgatatggtttgtctgtgtccctacccaaatctcatcttgaattgtaacttctacaattcccacatgtcatgggaggaaccctatgggaggtggttgaattatgggggtgggattttgctgtgctggtctcgtgatagtaagtctcacgagatctgatggttttaaaaatgggagtttccctgcacaagctcccttctcttgtctgctgccatgtgagacctgcctttcaccttctgccatgattgtgaggcctccctagccacatggaactgtgagtccagtaaacctctttcttttgtaaattgcccagtcttaggtatgtctttatcaagcagcgtgaaaacgaactaatacagggatcaactgtgtaaagctcctatgtgtgctgacagattgctttccagaaagttggtaacaatttgttcacatgtcatgtctgagaatgctactttcattctcctctgtgcggcaaaaattgtttgcaaaatcttagtcagtgtgataggtgagcagttgtgttttggttttcttactagggaaaggtgagcattttccttcattttttgtagaaggctgaaaaacacaaaaaaaactatccatccaaaatgctaccactgaaaagaagctctggaaatgtagaggtaaatgtctaacctagttctgcttccacacttcagaggcagacacagtgaacaggatcctgcttccccagccatttcctagtgcttatgcatcataaacacatttgtgttttctaaaaccaaaatggaaagaggagacacaaggtagtctataattcaccttttctaaaaacattattttatgatggaatattttagacgagctcttcgtggtttttttttttttttgcttttgcatttgtttcatgaatttatatttcatgtcctttgcccatttttcttttgaatgttttattctctgtaagagcactttctgtgttaaagatatcaactctatcaaatattgtgtatcagagatttttcttagtttgctaagaaactaagcaaacttagttattgcttatttgattttacttatacacagtgagtggctttaagaatgacttttgcagtaagtttgtgatttctcttctttgatttcttcctttgcttttagtaaagcttaggaaatgtttctccacactgccatctgtgaaatcatcacctctatcagagagatcagcaaacgtaactagttcaaatagttcagtgacgcaggagaatctcttgaacccaggagttcaagaccagtctgggcaacacagcaagaccccatctctgcagaaaataaaaaaaaaatagctgggcatggtggcacttgcctgtagtgtcagctactcaggaggctgaggtaggcggttgcttgagcctgggaggttgaggcagcagtgaacaatgattgcctcactgcactctagcctgagcaacagagcaagaccctgtctccaaaaaaaaaaaaaaaaaaa

SEQ ID NO: 4728 - DNA, 1243 bp, Homo sapiens
  misc_feature (327)..(327): n equals a,t,g, or c
  misc_feature (335)..(335): n equals a,t,g, or c
ggtcgacccacgcgtccgattttataaaaagtacagtttaacattccatttaccttgttactttttgactacaagtctttgcttcccttgccagtccctcttcccagttcttgaccaaatacacctaaaaaaggaatgtcacatttatggaactgtgtgatctttctttgaatctggtttaacattaaactatgggttttttgttgttgttctttgtgataagttccacctgctatacactgttagcgcaaagtatttttttggaacacttttgtattagttatggaaataaattttacacattggattaaaatgtagagaaacatncattgagnatactcagcaagtcctgctggactagaagctgttactttctgtaaaatgactctamatmtctttgctwyaaaccactatctactgtytcatagtttaactccaagagcagtttttgtttgttttccctaagctcttagataaatcctcagggatatctcagtgcttgacatattgtattataattgcttgtttgtctatttctcccactagaaactatgggatgatggtgagaatttcacagcaggaaagattgggaagtttaaggatctgaacaggagttaggtaggaaagtattacatgctatgatgtagctgtatataccaccaaaaattctaccttagaatggtttaggtcactgaatttcataattttacaattatttcatattcctttacataagaatttgtatgttgcaaggcttaagaagctttaatttatcagttcctattagcgtatcgtcctctttttgtgtcaagaaaagaaactcggctgggtgcggtggctcacgcttgtaatcccagcactttgtgtgggaggccgaggcagcgaatggattgcctgaggtcaggagtttgagaccagcctggctgacatggtgggaccctgtctctgctaaaaataaaaaagttaggtgggtgtggtggtgtgtgcctgtggtcccagctactggggaggctgaggcaggagactctcttgggcctgggaggcagaggttgcagtgggccgaggtcatgcccgctgcactccagcctgggcaacagagcgagactccgtctcaaaaaaaatataataaacctcattcttttatttaaaaggtaatattttttactggtaaaaattgataaaaataagccaaagacaacgattcaatcttaatctcatagaaaaaaaaaaaaaaagggcggcc

SEQ ID NO: 4729 - DNA, 2248 bp, Homo sapiens
  misc_feature (2234)..(2234): n equals a,t,g, or c
  misc_feature (2248)..(2248): n equals a,t,g, or c
gggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattgtccaagctggcagcgtttctgctcataaaacattctgaagaaccttgtgggccctctgtgtatgtcacaggattcactccattagatgggaagctcctctgcagatcttttctgagtaatcccmtctccatttctggcttctgctgagatggctgaggagacctgcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtaaaaaaaaaaaaaaaaaaaactcgaggggggcccgtcccaatnccctatagtrgcgn

SEQ ID NO: 4730 - DNA, 1803 bp, Homo sapiens
  misc_feature (1746)..(1746): n equals a,t,g, or c
  misc_feature (1773)..(1773): n equals a,t,g, or c
  misc_feature (1779)..(1779): n equals a,t,g, or c
  misc_feature (1793)..(1793): n equals a,t,g, or c
ggtcgacccacgcgtccgattgtccctcttcctccactaccttcccatgcccagcaagttctaatggagtaggagccatggcagctgccaggagatggaaaagcaatgaaagtgggtgggccctctgcaagggagccagccagctgcaggtgcaggggagttcagaggacatgtgagcaggaggcagcccgcctcccacgcctcgatggcccagacatgttctccaaggttgggactcagacacccaccacagcaatgccctacggcccagaccccatcctctcaaacgtcctcctagccggatacattgtcctccaaactctcagctgtcccaggtgatcatgagtgaagcccagttgtgctcacttctaactgcagcatccattctaaggaaaatctccactcccctcctctaaacctcatggggccaacatcgcacagtctgaacaacaagtgagccatcttgaaaaggagggcggctgtgcgtgtgaatgagcagggagaaaatgaaacaggagccccaccttacccccagtcacctcactgaatagcaccaagccaagtggggtgacatcacttcccagcaatcgggactcatagatggtcacggtgggcctagttatctgttttagtgaatggtgctgtgcaggtggcctcagtgcagaacagactgtgtcagacaaacatattgatgcactgatgaaggagaaggaagctgggaaaagctccggtcattatgacccgcgacaccaagggcaggctctggaggagccatccgtgcacagctgcatctattatctgctaactgaacaaacacagaaggtatccaccagaacaagtctactcagatacaggtggccctgcgaggaggttggttggtgttgggcttagacttgacaggttgtccggtggtgattcagcatgaaggtgtggctggctctgagattattatctcagattatcccctcacaaakgaaaatatmmamggaatcccagaaatctgtttatttcatatttgaaatgttatgtagactatwgatgaattttttttcttgaattatctggtgattaaaattgktattcttgktttgcttattatgkttttaagggatgataacgkttcaccctagtgkttcagggctgatagagacttagaagtcatctaactgccctcatcttacagacttaaaaagtggcatccaaattgatgaagggactccctgagtcacgcagcaaggtggcaatgaagtccctcagctcttacccctaccccatgcttgtgtcttcctgggcagcggtccccatcctttctggcaccagggaccggtttcatggaagacagcttttccatggtttgggggtggataggatgtaattcaagtgcattatattttttgtgcactttatttttattactacagtgtaatatatgatgaaataagtttacaactcaccataatgtagaatcagtgggagcttgtttttctgcaactagatggtcccatctgggtgtgatgggagacagtgacagatcatcaggcattagattctcataaggagcacacaacctacatccctcacatacacagttctcagttctcagtagggttcaagctcccatgagaatctgatgtggctgctgatctgacaggaggcagarctcaaggtggkcatgcsarcaatagggagcactgtaaataccgaaaaagcttygytcgcttggctggccgccccttctggtggggnggcccagttctaacaggccccaaaccncacctntcaagaaaaactgnttcctaagaa

SEQ ID NO: 4731 - DNA, 531 bp, Homo sapiens
tgaatgatcttcactaccccagatccaaagcccaagctagtcaaggtgtgcaggagcccccctgcagaataatgggccagtgagagaggccacacytctcaccctgcagaataakgggccaktgagagaggccacacatctcaccctgcagaataatgggccaatgagagaggccmcacatctcgttctgcataaatggagtatttgcctgcggtagtttgccactatgtctcccctwacccacctatttttttgtagtatatatattatttctacaacaaaagtgaatttgtaatgtagctttgaaaatcattctttctcaatgagaacacttggaaacaggatggggaaaatcacacactggggcctgtcgtggggtcggggaagcggggagggatagcattaggagatatatctaatgtaatataccaacatggcacacatatacatatgtaacaaacctgcatgttgtgcacatgtaccctggaacttaaagtataataataataaaaaaaaaaaaaaagggcggcc

SEQ ID NO: 4732 - DNA, 1520 bp, Homo sapiens
  misc_feature (716)..(716): n equals a,t,g, or c
  misc_feature (748)..(748): n equals a,t,g, or c
  misc_feature (1398)..(1398): n equals a,t,g, or c
  misc_feature (1410)..(1410): n equals a,t,g, or c
  misc_feature (1424)..(1424): n equals a,t,g, or c
  misc_feature (1432)..(1432): n equals a,t,g, or c
tcgacccacgcgtccgctcagagaatgtccagagctaagtctgagcaaagggccagcttttgcttttggggctggggtacaggcagattcctgttggagagcatttattttacttttcaagtgtgggctttctggaaggtaatgggaaactgcaaggtgtcttgcaagcaggtgtttggcttatggtgatgtggttcccagggtggcttttgggcaggggcagggcggggtcctccaggagctgtctgtcggtgctgagctcagtctgcttccctaccactcagcccactgcttggatggttccctctgtcactctcatcttacactgtccaggttttagcactgaaagtcatatgtgtgggaagcctctcagtcccaggccaaccagaacagttggtcgccccgtgtctaacatacctgtctaactgtctccagggcatggctcatcagcgtggctgtggcaccctctccctgccttctcttgtctccttcactgtcaagtctgggaaagggctcctggtgggtgtccgatgaggcacagctgggtgacaaagatggctccagctctggttggggcgtgcacctcatggtgacacctccctctgtgggacctccgagggtcaaggaaggaggcaccttccatcctaggtttaggattcattgcacttacacaggattccccgtggcagatcacctgtgttccagargctgtgtanttcaaggtgtgtgtgaggcagttgcatggtangggggcacctataactgggggtaagtctgtaatggtgcaatagatgatgttagaacagtgggggtccccctccctctcaggcctcaaaagcacaaccaccagarctggtgggtggcactgggccatggggagacctgaccagcaaggctccctctttcctctgtccaggccacccagcctgaratacagtgctggtcactctaaggaatgctgtggcccccaagggacaccccttgggtggctcctcccwggcttctcactgckggctggcargcargctggtgggcgggcaarcgtaatattacccctaagataaatgaagaagagtttcagcccttattggattatagtttttattgaactttataaattccaattagcagacccctgggcaataagcgacacacagcccgtggctcgctttatagcgtgattatgaccctgtttatcctcccctgaacgagaagtattaatggaggaaacaaaggaaagggactcaaaaatacataaaaacagatattggtgacacagagataaacagacaggagtcagggagagaaaacaatctccgggcaggcaagggggaacagagaatcagagattctaagaacccatgtgctcagaccaccgtgagcttggatgtccttctnggctcctcccanggcacaaacccctnagctcctnaagctgctggggctgaagagacctccctcccaagcctactcaggatcttgctggggtggatgtgattataatgaaatcaggtgccacc

SEQ ID NO: 4733 - DNA, 596 bp, Homo sapiens
  misc_feature (2)..(2): n equals a,t,g, or c
tncacatgcattatgtacacatgcacgcacaagtaattttgcctataggtacagggggttgtccaagctctgaaaactgatcatgcattctgccccytcctccaggggactgaaagcataagattaagaatccttgagtttgaattgaaccaagtaagatctgtctcccaggagcttccacctggagrwcctgagagcccacagacagatgggcagcctccaagggcctggccacagctgggaatgccctccaaccccacctgcttttcatttcttcctggatactctggtttgcgttcatcagctttaaatttctaacagccatgacccagaacagcagctgggaagaagctgtccctagagaggtgtgggggtgagctggggggtcctgagccagccaggtgggtggtggtactgctcttctggactgaaacccttgcccgacttgctgcatctcccaggagaaagaagtgtgctcaaggatggcgtgccctcctcactttgtctggctttgtttgcgccttcctcccccttctgcaggtcatctttcttggaggcttcagtggaagattaaaaaaaaaaaaaaaagggcggcc

SEQ ID NO: 4734 - DNA, 2093 bp, Homo sapiens
  misc_feature (2080)..(2080): n equals a,t,g, or c
ggctaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggaaaaaaaaaaaaaaaaatcgccgganggggggggccccg

SEQ ID NO: 4735 - DNA, 1301 bp, Homo sapiens
  misc_feature (10)..(10): n equals a,t,g, or c
  misc_feature (19)..(19): n equals a,t,g, or c
  misc_feature (891)..(891): n equals a,t,g, or c
acttttttcnctaatctyncaaaccccattttatggttttactacytttatggaacaacatcagtttagggttaagttagaaaatcagtgtatactaatatttgtcgattattgaatctgtatcacctttttataaatcttgaatctattaccacctctcaccttaaaaatcagggttggtagggaatagtcttttgtctctgcttctgggtgagcaaacaaatgctcctatgtcctaatgacatggtttcttaaaaactaaaaatttcctcaaagtacagctgattgtactctatcagaaaagaatagctcttcatcttttatcaaaatcataatctttgtcagttattccacatttaattcttgtaatctaatattgtaggccaattcagtcagtttttggtacctttgtagggtttctttaaatgtcaccaacttgcagattacttattacttgtgtgtaagcctttctaaaactagaaaaaattatttcttgtgcaacagaatctctttgcattagctggtgatgaagaaccagaggtacggaaaaatgtgtgccgagcacttgtgatgttgctcgaagttcgaatggatcgcctgcttcctcacatgcataatatagttgaggtaacactggcaatttaaaggctctttcatcatctttcccctaagagaaatactagatagaaaatacaacataccggatgggaaggggactataaaatagttataattgkcttaaaattataagttatctttgtggggagttttgkatttctgggkatagttgkacatactgkataactttggaagtgktttaagtagtatgttatctagagcctccttttcacttccaaagttccatatggtggagagaagagaggatctttnttaaaggttgcagtctaagatctgttaaaaggctagcattcgtggtatgcagcawttyttgttctaaaactttacacatggctgcatgaggtaggcctgttttttctttgaaaagtcaggcgggactgattgaaagtttagtgctaactaaagtgaagaaattttatcagttgcttggtcacagctggggagcctaatttataatgytacagttctttcttccacaatactcagtagcaaaagagtaggacatgatgtatcatgtaataggggttggcctatgacactgttgtgtgggcatattttgctaggtgagatgtttcagtccgtaagaggatgtgtacagtctattagttggcacttctaccctcaggtacgttgagaaaatcacgtgagtgaatttggcttgg

SEQ ID NO: 4736 - DNA, 1579 bp, Homo sapiens
  misc_feature (15)..(15): n equals a,t,g, or c
  misc_feature (26)..(26): n equals a,t,g, or c
  misc_feature (30)..(30): n equals a,t,g, or c
  misc_feature (1479)..(1479): n equals a,t,g, or c
  misc_feature (1532)..(1532): n equals a,t,g, or c
  misc_feature (1552)..(1552): n equals a,t,g, or c
  misc_feature (1562)..(1562): n equals a,t,g, or c
ggggggggggggtgnggaaagaggantctncctctttgggttaaggaaatttcmyaggacggtactcagcaagtgaggcagaaacattttctaacattttaaawtattttgctttactattaaatatgktaatatttgtttactacttgatagtcctacaggatttagccaattctctaccctacaaaaacagtaaacctctggaggaagtgcctctaacatatagtaggccctcaatagcaatttgccaagtgaataagtaaactgattttcttcacttgccattgttttcatggtatcatgtctgctaagtctaacatattgatgaaaagtttattggttaccagtacatggctataatgtataaccttggcaaagctgggtattcattgacagtagtaacaaaagtgacaaatgcaagatgatggcattgggtatccccacccccaacccagttgctgttctctagagtaaattaatgaaatcttttaataaaatttaatggaggatgtactgttaatggcaatgcctgctgggaaaatagtgctcttttgtatgtaaaatacaattaaaacaggaactacgtagttttgagagtgtcaaatgtggaagcaggacttggggaaatcaacattttaaaaatgctgcaatagtacttcacacagtgtcccatttgatcgttgaatttctcctctttcttataatgagattttaggttcattttgtagaggatttctgtgatttcctggaaaaagacagtgggacacattggatgttacttaactttttaaatgcttgttttactgcttttaatacatgtatgtgtaaataaagtaagactttatgtgtgacatgaggaaggcttcattgtgttttcctctcacatccccactctgagagatgtctttttcttctagtggaagcttgttggtgtagggaaatgagtgtgtgaactctgattccatgaaagccagattcagatcttctgctggttatcaagttacttaacttctattaatttatttccttatttgtaaaattgaataataacgtcttagagttttgaagataaaataktctgttgtccattcagacattgctttttacttgcagacgtagggaacagcataatatttattactaattttatggaacaacatcagtttagggttaagttagaaaatcagtgtatactaatatttgtcgattattgaatctgtatcacctttttataaatcttgaatctattaccacctctcaccttaaaaatcagggttggtagggaatagtcttttgtctctgcttctgggtgagcaaacaaatgctcctatgkcctaatgacatggtttcttaaaaactaaaaatttcctcaaagtacagctgattgkactctatcagaaaagaatagctcttcatcttttatcaaaatcataatctttgtcagttattccacatttaattcttgtaatctaatattgnaggccaattcagtcagtttttggtacctttgtagggcttctttaaatgtcacncaacttgcagattacttatnacttgtgtgnaagcctttctaaaaact

SEQ ID NO: 4737 - DNA, 1452 bp, Homo sapiens
ccacgcgtccgcggacggtggacggacgcgtgggtggacgcccaccatgccgccccgagggccagcctctgagctgctgctgctgcggctgctcctgctgggggcggccaccgctgctcccttggcaccgagaccctccaaggaggagctgacccgctgtctggcagaggtggtcacagaggtgctgaccgtgggccaggtccagagaggaccctgcactgctcttctccacaaggagttgtgcgggacagagccccacggctgtgcgtccaccgaggagaaaggcctgctgcttggggatttcaagaagcaggaggctgggaagatgaggtccagccaggaggtgagggatgaggaagaggaggaggtagcagagaggacccacaagtctgaggtccaggaacaagccatccgcatgcaagggcatcgccagctccaccaggaggaggacgaggaggaggagaaggaggagaggaagagggggcccatggagacctttgaggacctgtggcagcggcatctagagaatggaggggacctccagaagcgggtggcagagaaggccagtgacaaagagacggcccagttccaggcagaggagaagggggtgcgggtgctgggcggggaccgcagcctgtggcagggggccgagagaggcggaggagagaggcgcgaggacttgccccaccaccaccaccaccaccaccagccagaggctgagcccaggcaggagaaggaggaggcttcggagagggaggtgagtagggggatgaaggaggaacaccaacacagtttggaggcagggttgatgatggtcagtggagtcacaactcacagccaccggtgttggccctgcaccaccagatccatcactagtggatcacagtggccaagactgacaccacgactggctaacaacttccgtgcaaggcctttaccttatacttccacactactgtatggactacagcaaccaagatggcaccattgcacagaagcaagccaccatcactagcaagttggccactgtgaaaagtggctgctgtgcctacttcactaggtgacagacagacaccattgctgggtcatggaaaacaagatgtcaccatgattggtggcaccaaaagtgccgtaacagggtgggcatggtggctcacacctataatcctagggagggttaatcctttcagaggccaaggtgggagaatcccttgaggccaggagtttgagaccagcgtgggcaacatagtgaaaccgtgactctacaaataatttaaaaaattagccagcaatggtggcgcacgcctgtggtcccagctctcaggaggctgaggtggtgggattgcttgaacccgggagtttgaggctgcattgagtcatgattgtgccacagcagtcccgcctgggccacagagcaaaaccatcttaaaaaaaaaaaaaaaaaaaaaaaaa

SEQ ID NO: 4738 - DNA, 2017 bp, Homo sapiens
aattcggcacgagcggatccgttgcggctgcagctctgcagtcgggccgttccttcgccgccgccaggggtagcggtgtagctgcgcacgtcgcgcgcgctaccgcacccaggttcggcccgtagcgtctggcagcccggcgccatcttcatcgagcgccatggccgcagcctgcgggccgggagcggcgggtactgcttgctcctcggcttgcatttgtttctgctgaccgcgggccctgcctgggctggaacgaccctgacagaatgttgctgcgggatgtaaaagctcttaccctccactatgaccgctataccacctcccgcagctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaagggaaaaaaaaaaaaaaaaaaaaaaaaaaaaaaaaaaaaaaaaaaaaaaaaaa

SEQ ID NO: 4739 - DNA, 702 bp, Homo sapiens
gaattcggcacgagctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaagggagaccagtgtaaatttgatcatgatgcagagatagaaaaaaaaaaaaaaaaaactcga

SEQ ID NO: 4740 - DNA, 535 bp, Homo sapiens
  misc_feature (529)..(529): n equals a,t,g, or c
tccacgcgttggcggccgctctagaactagtggatcccccggsctggsagaattcggcasgrgccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggkgagggtggggagcagctcccagcacccctgctgtgtggttcatcttttttttaggcccctgcctgtctgcccatctgcccctcacccaccctaggctctgcccaccgcctggacctgcccacccctgaaagactggcccctggctccccgcccctcggtctccacgtggtgtatggatctgtggtcattgtccctctgcagaataaagattgctcaggcctgcctggaaaaaaaaaaaaaaaaaaaaaaaaaactcgagggggggcccgtacccaatcgcctgngatgat

SEQ ID NO: 4741 - DNA, 1816 bp, Homo sapiens
  misc_feature (1807)..(1807): n equals a,t,g, or c
ggcggccgctctagaactagtggatcccccgggcaggaattcggcacgagcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacgggtgcatttgtgagtcccctcagtgtctctgcagcttctatgtgtggatgaatagtgaagccacatgaggcctggtctgaagcagagaagatccgctcagcatcatgttgaatcccaagcccgcgtctccgtgggctccaggacaatcctatgaaagtgacaccgtcgttcattgttcacatcggggaggagaattccatctgaaaatgcacgtgacttcactgacacccgcgtccgtggcacagccctgtgctgagctccacagacctacagtccatcgcctccccttggagtgggcccacagctgcagacagtgttgtccaaagaagatgctctgagtagatgaatggaacaaactggaaactccagaaacaagcccttctttacattyctaatgtttggcttaaatggaaggtgccaagagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctsaggtgcccctgtgatccaggtcttcyaccctgaaaccccaycctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacagcactgcaaaatgggagcacagtattgggaaatgggagcacagtactgggaagtgggagcacagtactgagaagtgggagcacagtactgagaaatgggagtacactactgagaaatgggagcacagtactgggaaatgggcatacagtactggggaaatgggcatacagtactgaraaatgggarcacagtactgggaaatgggagcacagtactggggaaatgggarcccacagtwctgggaaaagggartttcacattactccggaaattgggarcmtaktactggggaawtgggagcacrttactggggaaatgggaaacattattactggggaaaccccngaacctgga

SEQ ID NO: 4742 - DNA, 631 bp, Homo sapiens
  misc_feature (337)..(338): n equals a,t,g, or c
gggaaatgggagctcacagcactgggaaatgggagcayagcaytgggaaatgggagcacagtactgggaattgggagcacagtactgggaaatgggagctcacagtactgggaaatgggagctcacagtactgggaaatgggagcacagtattcggaaatgggagcacagtactgggaaatgggagctcacagcactgggaaatggagcatagcattgggaaatgggagcacagtactgggaaatggaagctcacagtcctgrgaaatgggagcayagtrctgggaaatgggagcacagtactgrgaaatgggagcacagtactgggaaakgggagnncmcagtactgmggaaatgggagcayagtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtgcaaaaaaaaaaaaaaaaaaaaaaactcga

SEQ ID NO: 4743 - DNA, 1186 bp, Homo sapiens
  misc_feature (2)..(2): n equals a,t,g, or c
  misc_feature (31)..(31): n equals a,t,g, or c
  misc_feature (87)..(87): n equals a,t,g, or c
  misc_feature (92)..(92): n equals a,t,g, or c
cnaaacgcttcatttttaggcgtttgggtcngttctccactcgtgtacacccagacgggggctcgatggcacaggaagcagatgatnccccntgtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacaggactgcaaaaatgggagccagtattgggaaaatgggaagcacagtacttggggaagtggggagcacagtactgagaagtgggagcacagwactgagaaatgggagtacactactgagaaatgggagcacagtactgggaaatgggcatacagtactgggaaatgggcatacagtactgagaaatgggagcacagtactgggaaatgggagcacagtactgggaaatgggagcccacagtactgggaaaggggagttcacagtactcggaaatgggagcatagtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtgaaaaaaaaaaaaaa

SEQ ID NO: 4744 - DNA, 734 bp, Homo sapiens
tacccggcggattccaggaaggtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaatgtgaaaaaaaaaaaaaaaaaaaactcgaggggggcccggtaccctatta

SEQ ID NO: 4745 - DNA, 655 bp, Homo sapiens
ggcacgaggcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatgggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactactccatcaatttcttcaaacaaaaaaacaacagcaaaaaaaaaaaaaaaaaaaaaa

SEQ ID NO: 4746 - DNA, 1135 bp, Homo sapiens
acgagctgaaatcttggagggaagaaaacacatcccaccctgcctccgggaaggggcctctcctggacatgtctcctgcagctgctgctgagccagatggggaccagcaggacagacacgtcagcaaactcatcttctgcttctttgtcttcggcgccgtcttgttgtgtgtgggagtcctgctctccatctttgggttccaggcatgccaatataagcccctcccagactgccccatggtgctcaaggtggcggggctgcatgtgccgtggttgggcttggggctgtgatcctggcccgctcccgggcgcaacttcagctccgtgcagggctgcagagaggtcagcagatggaccccgaccgagccttcatctgtggagagagccgccagtttgcccagtgccttatctttgggtttctgttcttgacaagcggcatgctcatcagcgtcctgggcatttgggtccctggatgtggctccaactgggcgcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatgggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagcaaaaaaaaaaaaaaaaaa

SEQ ID NO: 4747 - DNA, 623 bp, Homo sapiens
acgcgtccggaaaaatagacatggccactcaatttatagctagcaaaaccctggccccaaaaccaggtaaggagagcaagggaagagaaagctataattcaatctcctgtaaaaagaaatgcaaatagcaaaatgaaaccatgacagaatgaaaagaacaatatacacatgatcaggtagcttttatactaggagttttaaaaaggaaactatcaatatagttttatatttaaacagattaaagaccagaccatgtaattaccttaatgtaacccacgctgataaaattaaatcaatgatgcaagtaaatgctttgtatgcaaacagtgatgccccagcacacatacctgcagcaccttgtctttggtttctgtctgcttattttatgcatcaatttatctgtgttagcacacagatatacactgtgttatttttcaatgacgggagaatattccattataaatggacagttgttggtttatttaagcaatctctctgcccaatggaaatataggtatttccagactttgctggtactcaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4748 - DNA, 552 bp, Homo sapiens
  misc_feature (533)..(533): n equals a,t,g, or c
  misc_feature (538)..(539): n equals a,t,g, or c
  misc_feature (550)..(550): n equals a,t,g, or c
ggaaaaatagacatggccactcaatttatagctagcaaaaccctggccccaaaaccaggtaaggagagcaagggaagagaaagctataattcaatctcctgtaaaaagaaatgcaaatagcaaaatgaaaccatgacagaatgaaaagaacaatatacacatgatcaggtagcttttatactaggagttttaaaaaggaaactatcaatatagttttatatttaaacagattaaagaccagaccatgtaattaccttaatgtaacccacgctgataaaattaaatcaatgatgcaagtaaatgctttgtatgcaaacagtgatgccccagcacacatacctgcagcaccttgtctttggtttctgtctgcttattttatgcatcaatttatctgtgttagcacacagatatacactgtgttatttttcaatgacgggagaatattccattataaatggacagttgttggtttatttaagcaatctctctgcccaatggaaatataggtatttccagactttgctgktactcanamaanngggcgtcgttngc

SEQ ID NO: 4749 - DNA, 529 bp, Homo sapiens
  misc_feature (519)..(519): n equals a,t,g, or c
  misc_feature (524)..(524): n equals a,t,g, or c
ggtcatctctcacctgtcttacttcttccagtcttgtctctcccattcagtctgttgttctccacccaggagccagagtaatcctttaaaaatgtaaatcagattagattatttatgtatgttagtcatttctactactttcattaattactggttcatatttatcatcccatttgataaaaaatctccagcatttccttttgcacgtgtataaaatccaagttagctgttaccatgtcgtgtatgatgtttctttcccttgctcctttttcaggcttcatcccatgccacttgccccatcacctgtaatgctaattctagttattttgttgttattttgtccttcctttcagttccttcccatcagcttttactccttcaatgtctatgcatttgccttttctggaatttctcctcctagctgtttgcatggctggcttcatttcatccaaagtagtttcttcctgktatattctgataacatcctggtttctccttcattgtatttataacaggctntaatnatgtg

SEQ ID NO: 4750 - DNA, 2900 bp, Homo sapiens
  misc_feature (5)..(5): n equals a,t,g, or c
tgggnacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaaatattccaagtcttcagaattcattaaatggatcttctgctggcagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggamtaccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagccaggttaagcatttggtattgtttcatttacaatttgggactaagatggaaacactttttttataagtttttaattcatagtcactaaagagataaatgtttcttatatacatttgtrtatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattagaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagctttttttttttttctagcatgtgttttctcctctttggttctctttgtatttactacttttctctttttcttgtgtttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaaccwaaaaaaaaaaaaaaaaaaaaaaaaaaaaaaaaaaaaaaaaa

SEQ ID NO: 4751 - DNA, 2852 bp, Homo sapiens
ggcacgaggtttttgtcaatatcaggcttttcaaaactcaaaaacaatccaaatgttgtaatttgttttgcataatgcccatggaattggatatcagtaagcaaagccattaaatcgaaccaatcaatgctaatagagtataaaaacaaaaaccttcaaattttaagtttcatttgtgtaactttattttcggcctagctagatcattgaagagccttgaaagttatctaaagtatggcttaatgtatttttttccctctgaaaaagatcatatgccaggatacttcttcaaaccagatcacttttaatatctagaaagataattttcaaggtataggcaaaagcacttcaaggacagagattatgtagcaagttgattctctaggaattctttgaactcatttgtgtwatagctggaacacactcctcttctttcctttaacaaatgaacttttagcacttctgtcttcaaggaaaaacatttgtttggaattggtggagggtactcgcagtccgtttatagtttgggacaattaataggaaaatccccagttgcattcaaataatagtgttgatgttgagggcactgactcattcagcatgtctgaactagaagtaaatttaattctgaaaggactgttagttaggaaataagtatttgtatacatatgtactgtggtaactttggattcattttaagtctgataaagtaagataaactttgtcttaaaaataaaattatgctaagtgaataaaaactgagatattttaagctaggcatctttgttagcatagtatccggaacataactacttataatgcttaggtcttatttctttggaaaataagttacttattccagaagccttagaaggaattctgaaaattcttctaactggccattaagagtaaggaagttgaatggtactgctgaagatctgagttgactcactgaaattttattttcttatttttttaacattaaaattatttctttttggctctccctctagttattttttaaattaaggtaattactgttttaacctagagcatataatggcaaattaaattttaatttgacactcataccgaactcagaaaagcttgtttgatcttctctaaattctgtatgtagtactttttttaattgtcacatttctttgttacatctttgtgtccaacaaaacctgtggaaatctgtgttcatttttgtggtgagggatgggggtgaaaaaggggagacttgctctaattatgcatatacatttgactatgtaaaggtagttgtagactatatgtataaataacaagttaacacttaatattctaaattgttctaaggaacagtggcctgaagccatgactagttttgtggagctgctggctcttttaacagtagctgacctattggatttaaactgagactgaaattgacatttgtggttaggttatctagctgaggcttttaacaatggagcagataatgtctgttcctgtagtggatccatttaatttcctatttgaggtactctcacttaacaagtattatctattctgaacctttgtgttgggaatttaaggactattgtcaaaggctattaatggtaaacaagtatatgcaaaacaattcacatatgggtaaaaatttcaaattgtgggtttttgtttttgctttttagtttcaaagattagttatgtagcagcaatatcataaccaaagcaagtaggaagttgactggtttggagaatcttcaagtagttttaaatactgtaatgtatcagattgttaaccaggatttttttttcctgtattactgctaaatatattactatattaatgcacttttgtatatataactgtcttctgtacattctgtacttactacagtgtatataaagcctgttttccctgaagctgtgagggaataacaatagttgtatcataagtcgtttctattttgagttccttcttgtacttgaaagtagttcagtagtgaaatctaaatgagtgtgtatggttgtaattaaaactggcaatgtggcagagctgtcttttgaaactgaataccagaatgaaaagtgttgttttggttaagaactcttataatatattatttcttttgatgtaccctgagttgttacacagcccactcactgctgcttactactttatacttctgagtcagctcctttcatgctctatcccagaatatttaccaacagaggagaactgctcccttttctgtttctcacagtttggttatggctttataaacttttatttggtgaaagccccagatacccaaatgtcattggcaaaacttatttttttttctggacagatcagatttctagagagagcagatttctagagagattagcattcatagtaagtgaaaattgtctaatttttttaatccatgctattactgggcagtaggtctaattttttttgacaaaaaatagatctattttccttatatattgatttagaatcttaagttagaattttatagaagaaatgtctgagcagttctatgtatggaggagcaattcagcttttcagcagcaactttatcttttgccactagagggagatctgtggttgctttctcctttggagaatagctgctttgcttttatttttaatttctaaggttggaatagaacttattctcaaaattcctttagtgttattaaatattttcatttattagtcaaaggtaagttaattaagcttgtttaatgatgccaatcttatgcttttctgtaatcttcaatttttaataaatgtgagttagatactaagtgaaaaaaaaaaaaaaaaaaaaaaaaaaaaaaaaaaaaaa

SEQ ID NO: 4752 - DNA, 1009 bp, Homo sapiens
gaattcggcacgagctcgtgccgaattctcgtgccgaactgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgcttaaaaaaaaaaaaaaaaaaaaaactcga

SEQ ID NO: 4753 - DNA, 1698 bp, Homo sapiens
ccacgcgtccgccggagtgagcgcgaccatcatgtccatgctcgtggtctttctcttgctgtggggtgtcacctggggcccagtgacagaagcagccatattttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgagggccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatgagacgctgcccgcgccggagttctccccggagccggagtccggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgtttaaaaaaaaaaaaaaaa

SEQ ID NO: 4754 - DNA, 1710 bp, Homo sapiens
  misc_feature (1026)..(1026): n equals a,t,g, or c
tcgacccacgcgtccgccggagtgagcgcgaccatcatgtccatgctcgtggtctttctcttgctgtggggtgtcacctggggcccagtgacagaagcagccatattttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatgagacgctgcccgcgccggagttctccccggagccggagtccggcagggccttgcggctgcggtgcctggcgcccctgganggcgcgcswttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgtttaaaaaaaaaaaaaaagggcggcc

SEQ ID NO: 4755 - DNA, 1525 bp, Homo sapiens; identical to SEQ ID NO: 3695
  misc_feature (78)..(78): n equals a,t,g, or c

SEQ ID NO: 4756 - DNA, 2533 bp, Homo sapiens
ccacgcgtccgcctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtaagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgtgtttcttcatatagctttaaaattatgctattgacattatgggaaagatttatcaatgagagaaatgtgtctctttttcagccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaaaaaaaaaaaaaaa

SEQ ID NO: 4757 - DNA, 1097 bp, Homo sapiens
ccacgcgtccgggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcactatgcccagcgcaagtggtacaccatgttggccaacgagaaagccccagttgagggtattgggcagccaagaagtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaacactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctgaaaaaaaaaaaaaaaaaaaaaaaaaaaa

SEQ ID NO: 4758 - DNA, 1889 bp, Homo sapiens
ctcatccttctatcatcatatggagtggcaataatgaaaatgaggaggcgctgatgatgaattggtatcatatcagtttcactgaccggccaatctacatcaaggactatgtgacactctatgtgaaaaacatcagagagctcgtactggcaggagacaagagtcgtccttttattacgtccagtcctacaaatggggctgaaactgttgcagaagcctgggtctctcaaaaccctaatagcaattattttggtgatgtacatttttatgactatatcagtgattgctggaactggaaagttttcccaaaagctcgatttgcatctgaatatggatatcagtcctggccgtccttcagtacattagaaaaggtctcgtctacagaggactggtctttcaatagcaagttttcacttcatcgacaacatcacgaaggtggtaacaaacaaatgctttatcaggctggacttcatttcaaactcccccaaagcacagatccattacgcacatttaaagataccatctaccttactcaggtgatgcaggcccagtgtgtcaaaacagaaactgaattctaccgccgtagtcgcagcgagatagtggatcagcaagggcacacgatgggggcactttattggcagttgaatgacatctggcaagctccttcctgggcttctcttgatacggaggaaagtggaaaatgcttcattactttgctcagaatttctttgctccactgttgccagtagctttgaaatgaaaacatgttctatatctatggtgtgtcagatcttcactcggattattcgatgacactcagtgtgagagtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgccatcatctctcagcaaggtgacatatttgtttttgacctggagacctcagctgtcgctccctttgtttggttggatgtaggaagcatcccagggagatttagtgacaatggtttcctcatgactgagaagacacgaactatattattttacccttgggagcccaccagcaagaatgagttggagcaatcttttcatgtgacctccttaacagatatttactgaaggaatctaggttgtattttcagtggacaatgggaataaagcatttctaaagcaccgactggagaggaaggcaacagagacaaggagagaagccgagagacatgtctgcgtgctgccacgcatctgagcgattgctctgtgaagagttgtacactgaacattttcaggggaggctgtttacccaggcaatgtcctcaaacaagcctgtgccggggtgtcctggaatctgtgccaggactgtgtttttagcccttcacctctcagctttagcaggacatgaaccagttataacaagatggccctgcagctggttacaagaatgtgacatggcaggatctatggaaccaaatggaaggttttgaggtgatgtaggtctttcacagttagctttggggaatacagaatactcaaataaagtgctttgttattatttcagagggaatggcgattgaaatgttacaacagagatttcttggtggtagctatttgggtaaaggtatatggatatttttctgtacatgtgaaattatataaaaataaaagttatataaattacattgaaaaaaaaaaaaaaaaaaaaaaaaa

SEQ ID NO: 4759 - DNA, 1249 bp, Homo sapiens
  misc_feature (1217)..(1217): n equals a,t,g, or c
ggccaggcgggtctcaaactcctcgtctcaggtgatctgcttgcctcggcctcccaaagtgctgggattacaggcgtgagcactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaattttaatttaacattttctatagatagcataccacgccaagtgtgctctgtcttgatccccttctttctagcatctgccagacattgtagagtttcscaascagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatwtgaatttatgtgacagctgaagtcacgagatgaggkatgtatgtcccccagggaggwtgcagaaagaagaaaagggtactggaaacagcatgtcagtggtgccagctgagggctggaggcagccaggagagttgggagcctgggtgctgggtggagagaggttaacagggaakacatgggaagtattgtgaaggctggtgtgagcaggggactactccagccctgttggaacatagagccatttggcagattgacaatgcagtgacagctgtatataataaatgtgttgaaaggaggaaggtgaggattttcttggtgggagtttatgctgttatttaacatattttgcttccaaaggggttaagatgttttacctaaatggargtttctaggtcagtgctatacaatatttctaatctgtgttttatagtgtgagctacatatgtaattttaaaattttcaagtagccacataataaaggaaacaggtgaaatttaaaaaaaaaaaaaaaaaaaaaaaaaaaaaaaaaaaaaaaaaaaaaaanaaaaaaaaaaaaaaaaaaaaaaaaaaaaaaaa

SEQ ID NO: 4760 - DNA, 579 bp, Homo sapiens
gcactgctcacctgcgcccttcccagctctcatttwtgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaaaaaaaaaaaaaaaaaaaaaaaaaaaaaaaaaaaaaaaaaaaaaaaaaaaaaaaaaaaaaaaaaaaaaaaaaaaaaaataaa

SEQ ID NO: 4761 - DNA, 562 bp, Homo sapiens
cagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcataaaaaaaaaaaaaaaaaaaaaaaaaaa

SEQ ID NO: 4762 - DNA, 837 bp, Homo sapiens
cacacccatgccctcaaacacaaccccagagcccgcccccacccccacagtggtgaccaccaccaaggcacaagccagggagccaactgccascccagtgccagtacctcacaccagcccaatccctgagatggaggccatgtcccccacgacacagccaagccccatgccatatacccagaggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgcc

SEQ ID NO: 4763 - DNA, 1354 bp, Homo sapiens
  misc_feature (867)..(867): n equals a,t,g, or c
  misc_feature (1186)..(1186): n equals a,t,g, or c
  misc_feature (1265)..(1265): n equals a,t,g, or c
  misc_feature (1286)..(1286): n equals a,t,g, or c
  misc_feature (1296)..(1296): n equals a,t,g, or c
gaattcggcacgaggtaacttttagaatgaggcagacaaagttggaaggctggttaattttccccttgttctcctgcttcagcttcatttccttgggttctgatgaaggacctgagatttttataagtcatcttaaaagccttgctgattactcaagagccttagtagaagtctgaaggggtgctctattgaggcctcatgtattcagcctcctactggtaacttttctgcataactggactgtaaccccagttacagatcttttaaaattttgccattctgaagtaagtctttattcctacagattawtgtgactagagtgttaacttttcgttgtatgaatcaaagcatgtcttcagggcctcttgcactattaccccagtacctagattcctatatacattcttatgattgcctcttatagttatcttcttatagttttatctcttctttgattcattttcatttcttttttttatagacacatttattcagcatcacgatcaaactattacatttagcaatcaacagcatgagtaaaaaaaattatctacactaaaactctttgttggcatgctttacaytttccacagaamagaaactaaaataacctgttatacaattagtcacaaatacagtcctacttttttttwtgcctatacacattaatattgtctaaaacatgtcttctttgtagcagctaggccctgccaccactgtgcttggctgagttcacaaatctgttgtaacctgtagcttcyytgtcacttctctggctctcttctgctaagtatttttctggcagtaattaaaatctgccactgccatasctactgactggaaccaccatagctgccttggttttgnggttttggccagtatagaatccagagcttctgcctccaaagtttcctcctttcgtgcatccaaaatttgaggactgattgttataattgccaaaattattgtagcttccaccacctccaaaattgctttcactgccaccaacaaagctgcttctgcctccatcgttgttatagctgtgagagctgacactcctgctgtagccactgccctgatttccataatcctgcctccacttccatagcctctgcttccttcagcgtaaccagggctgcccctctataaccactgttgttaccaaatccattatagccatccctgntgctaccagatcaccaccagcatggctgctaccaaaggcaccacaaccactgaaggttcttctccatgaccaaagttgncattcccaccaaaaccacctncacgaccatnaccagaggtttcagaaccattttcgacctctttgggctagatgaaacactaagcatct

SEQ ID NO: 4764 - DNA, 393 bp, Homo sapiens
cttctcttgatacagctcttctgtccaccttatgtagccttgcattcacggctgcatccacctcctccacagtggcatatgtgacaaacccaaagcccctggagcacttggtatttggatctctcattaccacagtctgtgagtgctccctgttgctcagaatggctcattggaccctcactggtcatttcaaagctcaactctctgatgaagaacttctacagctgttgggactacttaagagactctgtcttagacatgatagcagtgggaagagagactttaatgatgttttcagcggcatccatgggtagaaaaagccattctcgtttctaattgctgaatatactctgctgtgaaattagacttagggcaaactgagactcagtaggc

SEQ ID NO: 4765 - DNA, 932 bp, Homo sapiens
  misc_feature (888)..(888): n equals a,t,g, or c
  misc_feature (890)..(890): n equals a,t,g, or c
  misc_feature (892)..(892): n equals a,t,g, or c
aattcggcacgaggagcatcgctacttcaaggccaatgacacgctgggcttcatgcttatgttggctgtgctcatggcagctacccatgctgtctacggcaagctgctcctcttcgagtatcgtcaccgcaagatgaagccagtgcagatggtgccagccatcagccagaactggacattccatggtcccggggccaccggccaggctgctgccaactggatcgccggctttggccgtgggccatgccaccaaccctgctgggtatccggcagaatgggcatgcagccagccggcggctactgggcatggacgaggtcaagggtgaaaagcagctgggccgcatgttctacgcgatcacactgctctttctgctcctctggtcaccctacatcgtggcctgctactggcgagtgtttgtraaagcctgtgctgtgccccaccgctacctggccactgctgtttggatgagcttcgcccaggctgccgtcaacccaattgtctgcttcctgctcaacaaggacctcaagaagtgcctgaggactcaygccccctgctggggcacaggaggtgccggctcccagagaaccctactgtgtcatgtgaagcaggctggtaggcagacaggcagagagaaggtcatggccaccgtgatggggccaacagcaagggaggggtaggggcccatacaggagtcctcctttctgagctcagccccagcccctcgaaccacctgtaatctaggcacctttgccaacacctyccaaggatggaggactgggcgagggactgggaaagaggcatatttagttttgtggggcctgtctccgctgcctccttctccacttctacaatctcattctctctctctctctctctgtctctctctntntntctgtgtctcagaagtgacaattcaaaaaaaaaaaaaaaa

SEQ ID NO: 4766 - DNA, 511 bp, Homo sapiens
  misc_feature (459)..(459): n equals a,t,g, or c
  misc_feature (494)..(494): n equals a,t,g, or c
aattcggcacgagccagattcccataaagcacatggtctaatctgttacgtaacagcaagacagcgtcacctcacctgttctcgccctcaaatgggaacgctggcctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggsttctaggagatggctccaggaaggcggccaagaatgtragtgcaaagattggttcctgagagcccgagaagaaaattcatgacagtgtctgggctgccaaagaarcartgcccntgtgattctttcaagggcatgtgaagaaaacaagncaccaaaggcaccacag

SEQ ID NO: 4767 - DNA, 1879 bp, Homo sapiens
  misc_feature (41)..(41): n equals a,t,g, or c
agacctttgataacataaccattagcagagaggctcagggngaggtccctgcctcggactcaaagaccgaatgcacggccttgtaggggacgccccagattgtcagggatkgggggatggtccttggagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccctggtcaytcagtamtstkttactccaggaaggcacaggatggtacctaaagagaattagagaatgaacctggckrgacggatgtctaatcctgcrcctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagacacaaggtgtgggtctatcccacttcctagtgctccccacattccccatcagggcttcctcacgtggamaggtktgctartccaggcagttcacttgcagtttccttgtcctcatgcytcggggatgggagccmcgmcygaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattcaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgmatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggargagtgggtgtagccgtgcagcaagattggggcctcccccatcccagcttctccaccatcccagcaagtcaggatatcagacartcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtact

SEQ ID NO: 4768 - DNA, 1879 bp, Homo sapiens
  misc_feature (41)..(41): n equals a,t,g, or c
agacctttgataacataaccattagcagagaggctcagggngaggtccctgcctcggactcaaagaccgaatgcacggccttgtaggggacgccccagattgtcagggatkgggggatggtccttggagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccctggtcaytcagtamtstkttactccaggaaggcacaggatggtacctaaagagaattagagaatgaacctggckrgacggatgtctaatcctgcrcctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagacacaaggtgtgggtctatcccacttcctagtgctccccacattccccatcagggcttcctcacgtggamaggtktgctartccaggcagttcacttgcagtttccttgtcctcatgcytcggggatgggagccmcgmcygaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattcaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggargagtgggtgtagccgtgcagcaagattggggcctcccccatcccagcttctccaccatcccagcaagtcaggatatcagacartcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggyaggggctgtggccgtctttgtactctggtgatttttaaaaattgaatctttgtact

SEQ ID NO: 4769 - DNA, 2189 bp, Homo sapiens
ggaattcggcacgaggcgcccgaggatgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttcctggaatccgggcacgaattgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattccaaggaatgacagcattacctccagatatagaaagaccctataaagcagaaccctttggtgtgtggcacgtcttcttcctcttccctgcacagagatttctcccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctaaaaaaaaaaaaaaaaaaaa

SEQ ID NO: 4770 - DNA, 2831 bp, Homo sapiens
  misc_feature (182)..(182): n equals a,t,g, or c
  misc_feature (219)..(219): n equals a,t,g, or c
gggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggagnaagatagagaagactctccagaaagatgcagcgacanaatkgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtgcaacaggaggwtcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccrgtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcaygattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaaaaaaaaaaaaaaaactcgagactag

SEQ ID NO: 4771 - DNA, 431 bp, Homo sapiens
ggttaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctcctttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtaaaaaaaaaaaata

SEQ ID NO: 4772 - DNA, 1409 bp, Homo sapiens; identical to SEQ ID NO: 500
  misc_feature (1180)..(1180): n equals a,t,g, or c
  misc_feature (1384)..(1384): n equals a,t,g, or c
  misc_feature (1392)..(1392): n equals a,t,g, or c

SEQ ID NO: 4773 - DNA, 1697 bp, Homo sapiens; identical to SEQ ID NO: 3764
  misc_feature (1627)..(1627): n equals a,t,g, or c

SEQ ID NO: 4774 - DNA, 1005 bp, Homo sapiens
  misc_feature (488)..(488): n equals a,t,g, or c
caggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggncgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaaraaaraaaaaawaaaaactccgagggggggcccggtacccaattcgcc

SEQ ID NO: 4775 - DNA, 1171 bp, Homo sapiens
gcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccacgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggacccttgtgcccttggaaaacctcactccaagtagaggctgtatctggagtgagtgtctacagagaggggaattggtcagtgcatggcagaacttgacatggcagaactgttccgtgggccccagagcagggcctgccgtgccttcctacttggtcatcctgtggctgtaggtgcactgtcccaactgctcacacactttccagtcccctccctccattctcaccacagttacagtcggagcagggagagacaggacaccaagagacatgggcagggccacgtgtagtctggacagagcccacccagcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactacctttttttttttctggttttgccattcttttattcatgttgttacactcagtataggatagtttattaaaatcattatgtctgtagaaaaaaaaaaaaaaaaaaaaaa

SEQ ID NO: 4776 - DNA, 1273 bp, Homo sapiens
tcccccgggcctgcaggaattcggcagacccgrctgtaaagatggcggcttcctagtgagtcggcggctgatttagaaggaggttcaggctacggtgagccgaagggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaactcga

SEQ ID NO: 4777 - DNA, 1974 bp, Homo sapiens
gaattcggcacgaggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcgcaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttsccctccaggactagagggagagcagtgtgaaatcagcaaatgcccacaaccctgtcgaaatggaggtaaatgcattggtaaaagcaaatgtaagtkttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctga

SEQ ID NO: 4778 - DNA, 1225 bp, Homo sapiens
  misc_feature (1223)..(1223): n equals a,t,g, or c
ttttgaaaccsttcsgaattcccgkgtcgacccacgcgtccscacagatccatacaaacaggctgaccatcagggctggtcccaggccaccaggctgggtgcaatgcagaaatggagatctgccccggggaaggcagtttctgcccaaacggagccacgtgaggacgtctttggggatgtgtctccaagaaaagtgtgggctgccttcctcaccctggatgcctgtgggctgccttcctcaccctggatgcctgtgggctgccttcctcaccctggatgcctgtgggcagccttcctcaccctggatgcctgtgggctgccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggcagccttcctcaccctggatgcctgtgacttggtttccatgggggcttcctaagctcagggaccccaagcctccatcaaatctaatgacccgccctgtctctgaacacacctgtgttgtccccgagcccctcaccaaccccctctgcaacccggcccacgcatttcccatcctgaagggtccagctcataggccggcccatgtgttccctttacccctgctttgtccctacctggtggggagctgtcccttctgggccctagtgtggcacttcacacacaaatgtgtcctgtgggtggtatctgggcctccccctgcagtgaggggatgaccaatgtgcagagctcactgggcctggatatgggctcgggtggcacagaacagagagaaagtgctccgtaaaagtgagctgcgatgcggaggtgggcaagctcttccctggagggggaagagctctcaacccagagggatctgaccaggaaggttcaccccccctccacccaggaagcccctgcagacagtatgtgttttaggctttgctggccaaatggtctctgccgtgactactcagctctgccattgtggctgcagagtgaccatagaccttctgaaagtgaatgagtatgactgtgttccaataaaactttattgacagaaaaaaaaaaaaaaaaaaaagggcggccgctctagaggatccctcgacgnac

SEQ ID NO: 4779 - DNA, 692 bp, Homo sapiens
  misc_feature (466)..(466): n equals a,t,g, or c
  misc_feature (494)..(494): n equals a,t,g, or c
  misc_feature (579)..(579): n equals a,t,g, or c
  misc_feature (590)..(590): n equals a,t,g, or c
ttttgaaacccsttcsgaattcccgkgtcgacccacgcgtccgcacagatccatacaaacaggctgaccatcagggctggtcccaggccaccaggctgggtgcaatgcagaaatggagatctgccccggggaaggcagtttctgcccaaacggagccacgtgaggacgtctttggggatgtgtctccaagaaaagtgtgggctgccttcctcaccctggatgcctgtgggctgccttcctcaccctggatgcctgtgggctgccttcctcaccctggatgcctgtgggcagccttcctcaccctggatgcctgtgggctgccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggctgncttctcaccctggatgcctgtgggcagncttcctcacctggatgcctgtgggcagccttyctyacctggagcctgtgacttgggttcatgggggcttctaagcttaaggaccncaagcttcatnaattaatgaccgcctgttttgaaacactgggtggcccagccttaacaacccttgaaccggcaaagattcatctaaggcagtaagcggcatggtcttacctgt

SEQ ID NO: 4780 - DNA, 510 bp, Homo sapiens
  misc_feature (74)..(74): n equals a,t,g, or c
  misc_feature (458)..(458): n equals a,t,g, or c
  misc_feature (508)..(508): n equals a,t,g, or c
ccatgtttccctttaccccctgctttgtcccctacctggttgggagctgtcccttctgggccctagtgtgcacnttcaccacacaaatgtgtcctgtgggtggtatctggcctccccctgcagtgaggggatgaccaatgtgcagagctcactgggcctggatatgggctcgggtggcacagaacagagagaaagtgctccgtaaaagtgagctgcgatgcggaggtgggcaagctcttccctggagggggaagagctctcaacccagagggatctgaccaggaaggttcaccccccctccacccaggaagcccctgcagacagtatgtgttttaggctttgctggccaaatggtctctgccgtgactactcagctctgccaytgtggctgcagagtgaccatagaccttctgaaagtgaatgagtatgactgtgttccaataaaactttattgacanaaaaaaaaaaaaaaaaaaaagggcggccgctctagaggatccctcgacgnac

SEQ ID NO: 4781 - DNA, 578 bp, Homo sapiens
  misc_feature (4)..(4): n equals a,t,g, or c
  misc_feature (18)..(18): n equals a,t,g, or c
  misc_feature (509)..(509): n equals a,t,g, or c
  misc_feature (519)..(519): n equals a,t,g, or c
  misc_feature (535)..(535): n equals a,t,g, or c
  misc_feature (558)..(558): n equals a,t,g, or c
aggnaaatcttcttgaantagsgtcgacccacgcgtccggttggctttcccgctgcaggccagccggaagcactaaagcagagtccaggcaggcagggcagaggctgtgctggtgaaagaggctgagcagccattctagccggaggatacaaatgcccatggtgctgatcaactctggtaagcctggaagcaaatgctgctgggtcttcaggccaggcttgtcagctccctgctctgctctgtggtggggctgccctgggctggctctttccctttctggcccccaggtacgtctattcacaagaagatatgaaacaactctgcccaacacagggccctggtgactgtgggagaaaacctccccgctttgagttggcctgtgtgagagattccagggaattcccaggggaccagggcagaggccagacctgggttctgctgtgtggctactggacgaggggctttttcggggaagtagactggagatggagggccacttcggccactgnaaggggctgncacaaggcattaacanggagaaagaccacaagaccctgnctttcaatgggggtgcttgg

SEQ ID NO: 4782 - DNA, 936 bp, Homo sapiens
  misc_feature (893)..(893): n equals a,t,g, or c
  misc_feature (895)..(895): n equals a,t,g, or c
  misc_feature (905)..(905): n equals a,t,g, or c
  misc_feature (911)..(911): n equals a,t,g, or c
gtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaantnaaaaaaaaangaaacnaaaaaaaaaaaaaaaaaaaaaaaaa

SEQ ID NO: 4783 - DNA, 1126 bp, Homo sapiens
ggcasagccaaccctgaggactcagtgtgcatcctggaaggcttctctgtgactgcacttagcattcttcagcacctggtgtgccacagcggagcagttcgtctccctattactgtcaggagtgggggcagattctgctgctggggaaggaaacaggagcctggttcacagyttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcaagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggaaaaaaaaaaaaaaaaaaactcgag

SEQ ID NO: 4784 - DNA, 1475 bp, Homo sapiens
  misc_feature (1404)..(1404): n equals a,t,g, or c
  misc_feature (1470)..(1470): n equals a,t,g, or c
gaattcggcacgagctttcatcttttatgttcaaagtacttgatgcacaaagcctggactcttttatctctgtcctatagactgatgtctagtcagtattcattgtgacaaaattgtttcattagagcaagttggatagtgtatggagattattataaaatgatttaacttgtcttctgtcaagtaattttataattggtattaatgttcatttttttccagtaccagtttcagaagctttcatttgtgtatgcatgtgtgtgttaaataagtgtattagatacttgaaaaatagtaatttaaatttaaacaatttaaaaaatgaaattgtaattttatgtgtaaaggtgtctgatgtgctttattctgcactgaaaacaatattcatttacagctcaacagacaccaaatatattctaaaattactttcctagagttatcagaaaacagcactgtaataatgaaatcaaacccatctttctttatgatttattcttagtctgatacgcatcagcctggtaagccttcctgtctctctgcttacttaccaatcactccaaatgtcatgtctttgggcaggcattaaattcttgggttttgggttttgttggatggactgcartctgtgtgagcctatatgggtgtgtcaaatccagtctttggggtgtcatggaaacttagcatgatagacttgattttatccccaagttgacttggtaatttcattagatttcatcagtcacaacctgcattttatcttgtatgtgctgyctattggtcacaaaatcagaaaacctycttgtccattcataacattagctgttttttcaggtggctagagggacatgtcattgcttcatctgcatgaatttgaaagattaaatgcataaaggaattttcttagaagtagagtaggccttcaccatctctktaactgggaaagaagttttgggagtaacwtactcatcactcacacccccctcccctcaaacacacacactcacccattagaatgtaagggccttgaggcaggccttgtgtttgcttttcgtgttcactgtcagcatttagaatagtgatagtcatatagatggatagtgctcaatcaattattgtcaaataaagtaatctacttgttccttgatttagactagcaaaaggggctggtacattgtaggtacacagtaaatatttgtagaacagatgaatgaaccaacccaacagatttcttagragtagcctgcttttggttactaattattttatagaacatataaaagaaaattttagaatacctaatttgttcacaaaaatgttatattgtctcccctgatacttggtattcctgtgtcaggctgagcactaaggktatacattttttgktaagcatgtaattactgttanttctccatgtactttattttgtgtattgatttcagtagttgtagctgagggtaatccttaggggcngcagg

SEQ ID NO: 4785 - DNA, 644 bp, Homo sapiens
gaattcggcacgagatgtgttggagcgctatgtgtactgcataaccaaccgttcccacctaaccaaggaatttcagaaagagtccctcagcatgggtaagtattctgcctataggagctttgaagacaccgcttaggtctgagggtgaggcccgaaatactcagtaggctgtcactcaatatgttcttggttttttaattcatctacttggaagtaccaaattcatcactggaattgaataccagttacctacccagatgtgagttaatggccaaatgaaatactctggatctgatctttgtctgagttgctattacttagctcctcaagaaggatgatcaagccggacacgctggttcacgcctgtaatcctagcactttgggaggccgaggtgggcgaatggcttgagcccaggagttgagaccagcctgggaaacatggcaaggccccatctctacagaaactacagaaaattgggtaggcatggtggctcgagtcccagctgctcaggaggctgaggtgggaggatcgctggaacccaggaggttgaggctgcagtgagccgaagatcatgccactgcactctagcctgggcgacagagtgaaaccctgttgcgaaaaaaaaaaaaaaaaaaaaactcga

SEQ ID NO: 4786 - DNA, 609 bp, Homo sapiens
  misc_feature (9)..(9): n equals a,t,g, or c
  misc_feature (24)..(24): n equals a,t,g, or c
  misc_feature (45)..(45): n equals a,t,g, or c
  misc_feature (336)..(336): n equals a,t,g, or c
  misc_feature (560)..(560): n equals a,t,g, or c
  misc_feature (576)..(576): n equals a,t,g, or c
atttcagtnttttcacacttggancctcaaccatgtgtatttgtnggaaatggctacttaatttarggaaaagtttaaggtggcctggaaawtaagtagtagttgaactaatcaacaggamccaaaactactttcaatatatagtgtacttatacycaaagagagacggaccattttatggtggaaccctgtctatggtagtattttgtgatgttttatttttgttgctattgtttgcactgttttctcctataacagctcttctaagccttaagaggataaattttatatgagattcaaactcttatttttgttaagaaggatgtaagtcaccangcatggtggctcacacctgtaatcccagcactttgggaggccgtggcaggtggatcatgaggtaaggagctcgagatcagcctggccaacaatgtgaaaccccgtctctactaaaaaaaaaaaaaaaaagaattcaaaaattagccaggcctggtggcgcatgcctgtagtcccagctactcgggaggctgaggcaggagaatcattgaacctgggaagcagantttgcagtgagccganattgtgccactgcactccaacctgggtaacgga

SEQ ID NO: 4787 - DNA, 1268 bp, Homo sapiens
  misc_feature (1184)..(1184): n equals a,t,g, or c
  misc_feature (1240)..(1240): n equals a,t,g, or c
agggttgatgggttatggtcaggagtcccagctgggcccaccacctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtcgggacagctcgatgctcggcctgctgctgctctgcacccccagggcctggctcaccctctctggacctgtctgcttccaaggaagggaccctctgaggtcccacagaggccaccccagctgtgggtcgtgagcatctctgtcttgcagggacagcatcgtggccgagctggaccgagagatgagcagagcgtggacgtgaccaacaccaccttcctgctcatggccgcctccatctatctccacgaccagaacccggatgccgccctgcgtgcgctgcaccagggggacagcctggagtggtgagtggcctccctgctctgggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcggatccaaggacacggtgcccaggctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatggtcgctgtggatctgctcccatcccacctccatccacagagggcttagaattgcagggcgagccaggcatggtgacatgcacctatgtttccagctacttgggaggcggaagtcaggagtatcccttgagtctgggaggtggaggctgncagtgagccgtgatggtgccactgcactccagcctgggtggcagagccagaccctnactcacacacaaaaaaaaaaaaaaaaaa

SEQ ID NO: 4788 - DNA, 2011 bp, Homo sapiens
  misc_feature (107)..(107): n equals a,t,g, or c
  misc_feature (1991)..(1992): n equals a,t,g, or c
  misc_feature (1998)..(1998): n equals a,t,g, or c
gggctgggatgtgaggagcggcgggttccgggctccggctctgggtggcggcggctgtgagcggcggcactgcggcgcagcggcggaggccagcgggcgccgtcggngctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggyccggcggcggctgagccgcgctgcgcaccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcagtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgygaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccrgggggccggcacctgcaatgctcaggagcccagytygcacctggagagcacctcagatcccaggtggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctggttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtcaaaaaaaaaaaaaaaagggggccgcttaagggtccannttaagnaaggggaattgga

SEQ ID NO: 4789 - DNA, 941 bp, Homo sapiens; identical to SEQ ID NO: 2137

SEQ ID NO: 4790 - DNA, 685 bp, Homo sapiens
gaattcggcacgagcctcagccaccccagtagctaggactatagacacaagctagcctttttatacttactgttttcatcaaatgtctttttccaactagtttccaacctgtctttgtatttgaagtgcatctattgtagatagttcagtgttgcttttaaagtgcttactccatttgtgtttagtatgttgacatggttggatttagatctactattttgctttctgtttttattcctgtttatccttttttacttcttacagcttaatgaattttggggggggaatccattttaattctctcttgggtttttagctacatcttctttaggattgcactagagattacaatatacattcttaacgtctcacccttttgcctggggcggtggctcatgcctgtaatcccagcactttgggaggctgaggtgggtggattgcctgagctcaggagttccagaccggcttaggcaacatggtgaaaccctgtctctatgaaaaatacagaaacattagctggttgtggtggcacacacctgtagtcccagctacttgggaggctgaggtgggaggatcccttgagcctgggaggttgaggctgcagtgagctgagatcataccactgcattctagcctgggtgacagagtgagatgctgtctccaaaaaaaaaaaaaaaaaactcga

SEQ ID NO: 4791 - DNA, 1643 bp, Homo sapiens
  misc_feature (52)..(52): n equals a,t,g, or c
cgacaggagcctcgcctcgtgctcatctccatcattaatgagaataactgcntgatcttcagggctccagacatggaccagctggttttgcctagcaagcagccttcctcaaacaaactccacaactgcaggatatttggccttgacattaaaggcagagactgtggcaatraggcagctaagtggttcaccaacttcttgaaaactgaagcgtatagattggttcaatttragacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgcaaaaatgtttttaaaatgtgtgccttttattacctatcagtctatgttttgggagaaatgggaagcaacagatcactgtgtcctgatgtgcaggacgcatgttaccacactcacaaatgcctaatattggtctttatgtggccattgagtcctgttgactttccactcatgtgctttttactctagcattatggaatctgggctgtacttgagtatggaaattctcttatagacttagttttagtactctattacacctttactaagccacataaaagtaatctgtttgtgtgtaactgccagatataccacctggaattccaagtaagataaggaagaggatgacatttaaaagagaatggaattttgagagtaggaatgcaaggaagacagcatgaacatatttttttcagtgcaaataattttttcgtaacaaagaaacgaacaactttggtatgatcttaagcaaaaatactcactgaaatagtatgtggatgaattcacctacttacaattttatggtttctttgtaaataataaatgtgaatctcaatcctgcaaaaaaaaaaaaaaaaaaaaagttct

SEQ ID NO: 4792 - DNA, 748 bp, Homo sapiens
cgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacsyttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaaaaaaaaaaaaaaaactcgagggggggc

SEQ ID NO: 4793 - DNA, 2619 bp, Homo sapiens
  misc_feature (81)..(81): n equals a,t,g, or c
  misc_feature (2323)..(2323): n equals a,t,g, or c
cgctgagaaggagcagacaagatggcgacgtccgtggggcaccgatgtctgggattactgcacggggtcgcgccgtggcgnagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcsagttcytccggcgcaagctgaaagcckcaggcccggcctgtytgtggcctgcacagcgtgattagcccatcggatggaaggwtcctcaactttgggcaggtgaagaactgtgaggtggagcaggtaaagggggtcacctactccctggagtcgttcctgggcccgcgtatgtgcacagaggacctgcccttcccaccaggtgggtcactgcacaggcggggctaggcagccctgctgctgtgtggctggaccgggagggaggggaatgctggggaaggaactgaggctggcatgtggggcctccctgagaatccatgtgcagaccacackygggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctmccacctgttccagaggtgcagacaagaggtggcgagagccccrtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaactgtgttctgttcctggaggtggcctgaggctccccgacagcccagcacctgcgttcctggtgcgaacacgctagcacagggcctgccgcaggcctggnatgcgggcaacgcaggcgccaatgggctggcgctgagcctggagctcctctgccagcagctggatctgcatttccacctgttccagctctttctgcacctgctgctctacttcctggtcctcaggccccggctcctctctgttcagctccagccacctgcgcaggctgctcgcttgccgccgacagaccagargttctgcttggtggtctggtartgcagtagttgctgctggatctcctcaagttcagcctcaaggtccaggctgcctgcagttgaaagtcccggacgcgtgggc

SEQ ID NO: 4794 - DNA, 956 bp, Homo sapiens
  misc_feature (319)..(319): n equals a,t,g, or c
gtgagaatgaaagaagacacaaataactattaagccaggacaagagattcctgataaatcaggaaatatggtcatactactttgaatgtagttatctattaaatgtgtctcttgtcattcaactgtaaagctgtgttaagtttgagccttatttctcttagcttcctttgttgcctggaattgtgtctggcacgttgtggtggcagaagaaatgttagtgcccctttaaaaatgttcattatttaaacatatactatattgatgtagaactcataccatcccatttggggccttttatgagccattttctcagtatacnaawgtagaacaatgagcttaattatakgcttgtgtaatgataataactagcttttaccagcacagcctgttccaaggctaaggctaacgattttacttgagttctcttatatatttctcacaacagacctcacaggtaggtaatattattggtcttattaaactagaagaaaagataggtttagaaaaaactttgtttagagtcacctaactaattatgcagcagaatttkgatttgaactccagactctgactccgtacaccagtctcctaaatgttagaagaactgctataaaattttggaaaagaggatttaaaaaacattaatagtggctgggcacggtggctcccgcctgtaatcccagcgctttgggaggctggggcgggcggatcacctgaggtcaggagttcaagaccagcctggccgacatggtgaaaccctgtctctactaaaaatacaaaaattagccaggcgtggtggtgggcgcctgtaatcccagctactcaggaggctgaaggaggagagaatcacttgaactcaggagaggaagattgcagtgagccaagattgcaccactgcactccagcctgtgtgacagagcgagacgctctctcaaaaaaaaaaaaaaaaaactcga

SEQ ID NO: 4795 - DNA, 1738 bp, Homo sapiens
ggcacgaggsmcactggaacgacctcaatctctgcctcctcgccagttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtatcggcgcggaacccggactgagacatgccttttgaacttctcagatagaggaaccccagtgaagactgatcagttcttacagttctcaaagcatggcccataaatatgtgggtttgcagtatcacggatcagtgacatttsrggatgtggccatagccttytcccagcaggagtgggagagtctggactcttcccagaggggcttgtacagagatgtgatgttggagaactacaggaacttggtgtcaatgggacattcccgttctaaaccacatgtgatcgccttattggaacmmtggaaagagcctgaagtgacagtgaggaaagatggaagaagatggtgcacaggataagaaagctccagtctacaaacaaaacatgccagaagatttttaggcgatgatgccacctgcacatggaaccaaagatttgcattggaagatgatacaatcggctgtaaagaaatgcccacctctgaaaactgtccatcttttgctctacatcagaaawtaaktagacagaaaccacgtgaatktcgggaatwtggaaaraccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctwtaaatatgaaaaatgtgggamggcctttatcmgwggctcagcctttgttaagcatgggagaattcacactggtgagaagccactcaaatgtaagcaatgtggaaagactattagcggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggaaaaccttcagtcgtgcctcatatcttgttcaacatggaagacttcacactggcgagaagccctgtgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagaggaaccctaaaagtaaaggag

SEQ ID NO: 4796 - DNA, 794 bp, Homo sapiens
  misc_feature (13)..(13): n equals a,t,g, or c
  misc_feature (19)..(19): n equals a,t,g, or c
  misc_feature (39)..(39): n equals a,t,g, or c
  misc_feature (48)..(48): n equals a,t,g, or c
  misc_feature (183)..(183): n equals a,t,g, or c
  misc_feature (189)..(189): n equals a,t,g, or c
acttggggaaaangaaaanccccatttattgaaagtttnccggggggnaaaattggttgggggaaaaaaggcctttttttccttaaggttaattattggggaaaaaaggcttttaacccccggggccattccaagaaggttaccttccaccaacttgggttgaaaaaaaaccccttttggggnttgttnaaggaagtgttgggaaaggccttcagtaccttttcatacctggttcaacatcagcgaattcataccagtgaaaamccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgrattcatgcagrgwtaaagccctacggwtgcaaggaatgcgggaaaaccttcagtcgtgcctcatatcttgttcaacatggaagacttcacactggcgagaagccctgtgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctataagtgtaaggaggaaggctg

SEQ ID NO: 4797 - DNA, 637 bp, Homo sapiens
  misc_feature (15)..(15): n equals a,t,g, or c
atcaaagaattcatnctggggagaaaccctatgaatgtaacaaatgtgggaaagcctttactgtttatggacaacttattggacatcagagtgttcacactggtgagaaaccttttgaatgtaaggaatgygggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtrgctcaaacattgttgaacatcggggaatttatgctggtaggaaactttcaaatgtgaagaatattggcaggtctattctcatcttataattcataatataactcagaaaacataagaatattcctttgtcatttataggtttgtaataccaatatttatactggtggaccattcagaaaaagtgggaaacattattacttaatggttacagcactgacagcatgaacttttatatgatgcatttattctaatgtgattgtatgaacaagtgaataaaaaaccttggacctcctaaaaaaaaaaaaaaaaaaaactcgag

SEQ ID NO: 4798 - DNA, 270 bp, Homo sapiens
  misc_feature (23)..(23): n equals a,t,g, or c
ccctatgagtgtaaggaatgtgncaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaggccctattggctaacttat

SEQ ID NO: 4799 - DNA, 1926 bp, Homo sapiens
  misc_feature (1925)..(1925): n equals a,t,g, or c
gccggcctgatcatagagtggaaaaatgaaaggcagaggtgaaggaagaatactaaatgtgaaaggctgaaatacacagggaagtgttgccagtgtgcaacagaatctcatctcgtgcaaaattgaattagacttccttactccttccttactctgggtaggtccatgtgcagcctttcctcagagcatctagcctgacatacttggctcatctgctgtgcttctaagccaaataaaaatcatcaaacacatcgaagatatttttgggagtcaccaggttaaagcaaagcctcagtcactgaaagcaaaaactgaattggccaggtctccactgacaaaacagagtaaatgatagtatgacagataatttcaagttttccaagactccaatttctgaaaaatgtctcatgactccaaaaaatcacgtacttcctaaaatgttgccagtggaggaccgaatcaaggttattgctgacctcattttttcaaccttttcagttatttgacctgaataggcaatcccccaggatttctgattgaattctacctgaaagtttagattttaaaagacaacctgtaggaagctaagtctcaggcaacaaaatttaaaaccatcagaacttgtttctccaaacatcaacctgctcctgtcaagtcctttttcatctctcccttttgtccctttacatactgttttgtaagttccttttgatatcatttattgcaggcagtatttttacatccatcttcaagaaacttgggagacatttagacatttagtatgtgtamatktctcccaagtttcttgcctctttatttcagataatgcctgtgattagtgaatggcggcattattcctgaagacaaatgaaggaacatagggagcaagattgactgtcatttgaatgatggaagagaagtagaattactgtgaggttacaaaaatcgtaagttagcagacattgagaaaggaaaacttcctacttgggcttttcaggcttatgtgacattatctggatgtgttttctagtctttcctaaaggagaaatttttattcctgggttgctgaaagctttctggactaaaaggatataagcagctcaatagcagcatagaggattagattaayggaacagcactgcatacaggaaagctacatctccaatagtttaggctgcaagtcagtagccaaacacaagagcatgtaagatttggaggacaaagtataaatattttaagtttacacaaccaagattataggctaccttcccaacttctaatttgaagagcactgaaaatggagctgtgaacacttcatttttaaaacctgacaatatggtgctattgactacttaatacaaagatatattacaatatttttaggtaaatgtattaagtctggcctgggcataaatgtacatacagaaaatgtttgtagagaattcatcaaaatcatgcccatttgctgttgtagagctacagtattcttcaatggtggtgactgaccagtgagtttctacttcttacagatgggacacaacagtcatgggctgtctcagctgcccaaagcctgaggcagaccacatgagagctgtggcttcttcttggattcaggttggataacccaattcagtaattaaatatgtaaattttggggggggttggggggtgttttctaggaacttgaagagtacgtgacattataaaaaatgggtgttggaagactaattgtagaaatttgacctgagggccaatgttacttggtgtaagttcactcagacagacatgtcagaacatgcccaaagaagcctatatcttgctgctgggaaatgtaaagcagttggcatgtagaatacgataataaatcatttaagaaaccaccaaaaaaaaaaaaaaaaaaccccgrggggggccccgwacccatnc

SEQ ID NO: 4800 - DNA, 1604 bp, Homo sapiens
ccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggygctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgrgatggagtctcgctctgttgcccagggtggagtgcagcggtgcgatctcggctcactgcaacctccacctcccgggttcrggcggattctcgtgcctcagcctcctgagtagctgggattrcaggcatgcaccaccatgcccggataatttttgtrtttttagtararatggggtttcactrtgttggcaggctggtctcgaacacctgactcgtggtccacccgcmtcggcctcccaaagcactgggatwacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaasattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtawgccccatgtgggcaggcgctcatgattgtttctgattgtttcacgcatgctgctaacccagagcctgggcccaaagctagttagtactcaataaacaatgcattgaaaaaaaaaaaaaaagggcggccgctctagaggatccaagcttacgt

SEQ ID NO: 4801 - DNA, 1763 bp, Homo sapiens
ggcacagcgtttccgaaggaccaccgggaacagacggatcggcagggcgrggcggaacggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaayggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaaaaaaaaaaaaaataaaaagaaaaaaaaaaaaaaaaaa

SEQ ID NO: 4802 - DNA, 2288 bp, Homo sapiens
  misc_feature (5)..(5): n equals a,t,g, or c
  misc_feature (2231)..(2231): n equals a,t,g, or c
  misc_feature (2256)..(2256): n equals a,t,g, or c
  misc_feature (2275)..(2275): n equals a,t,g, or c
ggttncccttgggttaaaagaaaggcccttgaaattggttcctggttgccccttccctagctgaccactctgaactgtatttgcttgtgtagacatggatcctgcagcattactgttcatactgccaaagggtggaaacgaaggtagtttatttgatgatactccactattcaagttggaggatgatgaagatgaagttgaagctgtggtcaaagttgaattagctgtggcaactgaagtagatatggcaacacctgaagtcactgtcatagtgctgctcgctgcagatgctaaggtggcagatggagtattagcatttccagtatttgtcatctgaggtggagtaatcaaagactgacttgtaggggcaactaaatttggctgggaaagtagagagctgtccaatggcagggaagcaagataaggacctaggtcatatctgcagacttgtgcataaagcttgagtttagaaaatgcttcattgttaccatcagctgcctgagaaaaccattctgctaccaacttttctgatagtttctttgatgcagtagatccaactctcatgatcccatctgttaacagtcgagaaacaggtctatgttgacctaatcgacaggactcatatattgcagtaagatctctaaaaaagctttttgctccatttaacaaggcttcattttctggacacagtacaacataggctatatctctttgagatccatagggttccagcataagtctctcccaataaggaagagcaaatggagaaagcaccagataatcataatcataacccaacaaaaatgtggggattggcagtggttctggggattcatcagttccataagagcctcggccagccattttatgaaattgttgccaagtgagaggaccctgaacaccccaaggtcttactgttctttttttctgaatggcatcctgaagaactggctgaagagagaggagcattcgaagtatatcctgtgagcactgcatactcacatcgtttcttttggaccaggggtgtaagcatgaacttttcacaagtgcttcatcaacttttcctcctgacatgttatccatgaactgacgcccatgttctaatgcaaggtagcagtcattgcaacagtcacgctcttcaacacgtacccaattgctaattacaccacttttaggaaaaggatcttggtctgctgctccaaagggtgaaaataaattagtgcactgatcttgtagcaataatatcaaatcatcagataatttttcagattcctttagtcctccattaacatgttcagcagaggtagccctgagagcttcaaaacgtttttctgcttctttgccacagtctgtattgcgtcctatgatatctagttcatcttcaagaaataatcctgaattgtttccaaattttctgttcatgacagcactgaagccacaggtacacctatattgtgcttcctgcgttggatctggaatgtaaactccaacatcggcacccttgatgttcatgttgcaaacacagatgcaacaactatcaaagttacagtctttaaacaaattcataactgattctgaaaggatgaggtttacataaagactgtgtgcttcagggatgraagggacagttgcaggttcaacagaattaaggggtctgcatgtagatggggtagaagctggtgaatacaagtctgaattttcatatttgactgaaccttgagcactagcaggtccaccagctccacgaggagtccgaggagtccttggagtccttggagttggaaaccgaggggtggatggagaaggaagaattcctgctccgctgttactaggaggtgcactgctaggaggcatcccaaaagaagtatgagtttgaggtgtataagcagtgccatattcttgatccatattacttccatcaccctctttgatgaatggcattgaaggccctgaagaaagcaattccaattttccaacagtccaactctgacggtaaatacactcttctggcaatttgatagggggcagatattggcttggtagagtttttagaggtgcaaacatggaacatcccactagaatttgacaattttcaggcttatagacataagaaaaatcctacaatataaagatggtaggttttcagtatcttatcttctaggaggaaaaaataaataaacaaacaggctctggacctttttcacctttctttaaacagattaaatcttaantacattctattattttcttaatgcntcttaatagtgacaacatnattcagtcctcaa

SEQ ID NO: 4803 - DNA, 985 bp, Homo sapiens
  misc_feature (977)..(977): n equals a,t,g, or c
tagggtccagctgtcctcctctcccctcccctgctggccactcctgctgccgtctccacagctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccagggctccactaaggaggggaggggctgtcttgcagcagcttgcacttcagcaccttagggccaggggttgggggccgccgcagatggggttcagggaagncccagggt

SEQ ID NO: 4804 - DNA, 899 bp, Homo sapiens
ggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcactgccacttaacttgtttgttggtgacacagttgttcagagtggggagaattcaccccattctgtccctgcccctagtcacctagctgtgagggtgcctgaggctgaatggctccaccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccag

SEQ ID NO: 4805 - DNA, 3398 bp, Homo sapiens; identical to SEQ ID NO: 3132
  misc_feature (3394)..(3398): n equals a,t,g, or c

SEQ ID NO: 4806 - DNA, 1797 bp, Homo sapiens
ccacgcgtccggtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattgttgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaaaaaaaaaaaaaaa

SEQ ID NO: 4807 - DNA, 1538 bp, Homo sapiens
cgcagcttgatggcgtcgggctggagagccgcagtcccggctgcagcacctgggagaaggcagaccgtgtgagggggcctgtggcccagcgtgctgtggcctcsgggagtgggaagtggaggcaggagccttccttacacttcgccatgagtttcctsatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttmccmaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagasatgtctatggtagctgagccaaacacgtaggatttccgttttaaggttcacatggaaaaggttatagctttgccttgagattgactcattaaaatcagagactgtaaaaaaaaaaaaaaaaaaaagggcggcc

SEQ ID NO: 4808 - DNA, 5065 bp, Homo sapiens
  misc_feature (3)..(3): n equals a,t,g, or c
  misc_feature (2535)..(2535): n equals a,t,g, or c
ggntttttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgagaactacgtgaagaatgcagaagcctcaggagccgatgcgatcaactggaagaaagggtatcagcratggaagatgaaatgaatgaaatgaagcgagaagggaagtttagagaaaaaagaataaaaagaaatgarcaaagcctccaagaaatatgggactatgtgaaaagaccaaatctacgtctgattggtgtacctgaaagtgayggggagaatggaaccaagttggaaaacactctgcaggatattatccaggagaacttccccaatctagcaaggcaggccaacrttcagattcaggaaatacagagaacgccacaaagatactcctcgagaagagcaactccaagacacataattgtcagattcaccaaagttgaaatgaaggaaaaaatgttaagggcagccagagagaaaggtcgggttacccwcaaagggaagcccatcagactaacagcggatctctcggcagaaacyctacaagccagaagagagtgggggccaatattcaacattcttaaagaaaagaattttcaacccagaatttcatatccagccaaactaagcttcataagtgaaggagaaataaaatmctttacagacaagcaaatgctgagagattttgtcaccaccaggcctgccctaaaagagctcctgaaggaagcrctaaacatggaaaggaacaaccggtaccagccrctgcaaaawcatgccaaawtgtaaagaccatcgagrctaggaagaaactgcatcaactaacgagcaaaataaccagctaacatcataatgacaggatcaaattcacacataacaatattaactttaaatgtaaatggrctaaatgctccaattaaaagacacagactggcaaattggataaagagtcaagacccatcagtgtgctgtattcaggaaacccatctcacgtgcagagacacacataggctcaaaataaarggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacawtaataatgggagactttaacaccccactgtcaacattagacagatcaacgagacagaaagtyaacaaggatacccaggaattgaactcagctctgcaccaagcggacctaatagacatctacagaactctccaccccaaatcaacagaatatacatttttttcagcaccacaccacacctattccaaaattgaccacatasttggaagtaaagctctcctcagcaaatgtaaaagaacagaaattataacaaactrtctctcagaccacagtgcaatcaaactagaactcaggattaagaawctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacrcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatyaatgaatccaggagctggttttttgaaargatcaacaaaattgatagaccgctagcaagactaataaagaaraaaagagagaagaatcaaatagacgcaataaaaaatgataaaggggatatcaccaccgatcccacagaaatacaaactaccatcagagaatactacaaacacctctaygcaaataaactagaaaatctagaagaaatggataaattcctcgacacatacacyctcccaagactaaaccaggaagaagttgaatctctgaatagaccaataacaggmtctgaaattgwggcaataatyaatagcttaccaaccaaaaaragtccaggaccagatggattcacagccgaattctaccagaggtacaaggaggarctggtaccattccttctgaaactattccaatcaatagaaaaagagggaatcctccctaactcattttatgaggccagcatcatcctgataccaaagccnggcagagacacaacmaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaayatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatyaggcaggagaaggaaataaagggtattcaattaggaaaagaggaagtcaaattgtccctgtttgcagaygacatgattgtatatctagaaaaccccatygtctcagcccaaaatctccttaagctgataagcaacttcagcaaagtctcaggatacaaaatcaatgtgcaaaaatcacaagcattcttatacaccaayaacagacaaacagagagccaaatcatgagtgaactcccattcacaattgcttcaaagagaataaaatacctaggaatccaacttacaagggatgtgaaggacctcttcaaggagaactacaaaccactgctcaakgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatygccaagtcaatcctaagccaaaagaacaaagctggaggcatcayrctacctgacttcaaactatactacaaggctacagtaaccaaaacagcatggtactggtaccaaaacagagatatagaycaatggaacagaacagagccctcagaaataayrccrcayatctacaacyatctgatctttgacaaacctgasaaaaacaagmaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgwctaaaacaccaaaagcaatggcaacaaaagccaaaattgacaaatgggatctaattaaactaaagagcttctgcacagcaaaagaaactaccatcagagtgaacaggcaacctacaraatgggagaaaatttttgcaayctactcatctgacaaagggctaatatccagaatctacaawgaactcaaacaaatttacaagaaaaaaacaaacaaccccatcaaaaagtgggcraaggatatgaacagacacttctcaaaagaagacatttatgcagccaaaaracacatgaaaaaatgctcatcatcactggccatcagagaaatgcaaatcaaaaccacaatgagataccatctcacaccagttagaatggcratcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggaytataaatcatgctgctataaagacacatgcacacgtatgtttattgcggcaytattcacaatagcaaagacttggaaccaacccaaatgtccaacaatgatagactggattaagaaaatgtggcacatatacaccatggaatactatgcagccataaaaaatgatgagttcatgtcctttgtagggacatggatgaarytggaaaycatcattctcagyaaactatcgcaagracaaaaaaccaaacaccgcatrttctcactcataggtgggaattgaacaatgagawcacatggacacaggaaggggaacatcacacwctggggactgttgtggggtggggggaggggggagggatagcattrggagatatacctaatgctaratgacgagttartgggtgcagcrcaccagcatggcacatgtatacatatgtaactaacctgcacattgtgcacatgtaccctaaaacttaaagtataataawaaataaaawtaaaaawaataaaaaataacccatagaaaaagaaaaaaaaaaaaa

SEQ ID NO: 4809 - DNA, 4709 bp, Homo sapiens
  misc_feature (14)..(14): n equals a,t,g, or c
  misc_feature (18)..(18): n equals a,t,g, or c
  misc_feature (30)..(30): n equals a,t,g, or c
  misc_feature (34)..(34): n equals a,t,g, or c
  misc_feature (177)..(177): n equals a,t,g, or c
  misc_feature (2213)..(2213): n equals a,t,g, or c
  misc_feature (3846)..(3846): n equals a,t,g, or c
ataccccccctccntacnggaacgacccanggangatttcctctttttctatcgattggaatattttcagaaggaatgttaccagttcctccttgtacctctggtagaattcagctgtgaatccatctggtcctggactctttttggttggtaagctattgattattgccacaatwncagagaacgccacaaagatactcctcgagaagagcaactccaagacacataattgtcagattcaccaaagttgaaatgaaggaaaaaatgttaagggcagccagagagaaaggtcgggttacccwcaaagggaagcccatcagactaacagcggatctctcggcagaaacyctacaagccagaagagagtgggggccaatattcaacattcttaaagaaaagaattttcaacccagaatttcatatccagccaaactaagcttcataagtgaaggagaaataaaatmctttacagacaagcaaatgctgagagattttgtcaccaccaggcctgccctaaaagagctcctgaaggaagcrctaaacatggaaaggaacaaccggtaccagccrctgcaaaawcatgccaaawtgtaaagaccatcgagrctaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaarggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacawtaataatgggagactttaacaccccactgtcaacattagacagatcaacgagacagaaagtyaacaaggatacccaggaattgaactcagctctgcaccaagcggacctaatagacatctacagaactctccaccccaaatcaacagaatatacatttttttcagcacccacacctattccaaaattgaccacatasttggaagtaaagctctcctcagcaaatgtaaaagaacagaaattataacaaactrtctctcagaccacagtgcaatcaaactagaactcaggattaagaawctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacrcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaratcagagcagaactgaaggaaatagagacacaaaaaacccttcaaaaaatyaatgaatccaggagctggttttttgaaargatcaacaaaattgatagaccgctagcaagactaataaagaaraaaagagagaagaatcaaatagacgcaataaaaaatgataaaggggatatcaccaccgatcccacagaaatacaaactaccatcagagaatactayaaacacctctaygcaaataaactagaaaatctagaagaaatggataaattcctcgacacatacacyctcccaagactaaaccaggaagaagttgaatctctgaatagaccaataacaggctctgaaattgwggcaataatyaatagcttaccaaccaaaaaragtccaggaccagatggattcacagccgaattctaccagaggtacaaggaggarctggtaccattccttctgaaactattccaatcaatagaaaaagagggaatcctccctaactcattttatgaggccagcatcatcctgataccaaagccnggcagagacacaacmaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaayatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacrtatytcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatyaggcaggagaaggaaataaagggtattcaattaggaaaagaggaagtcaaattgtccctgtttgcagaygacatgattgtatatctagaaaaccccatygtctcagcccaaaatctccttaagctgataagcaacttcagcaaagtctcaggatacaaaatcaatgtrcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaakgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatygccaagtcaatcctaagccaaaagaacaaagctggaggcatcacrctacctgacttcaaactatactacaaggctacagtaaccaaaacagcatggtactggtaccaaaacagagatatagaycaatggaacagaacagagccctcagaaataayrccrcayatctacaacyatctgatctttgacaaacctgasaaaaacaagmaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgwctaaaacaccaaaagcaatggcaacaaaagccaaaattgacaaatgggatctaattaaactaaagagcttctgcacagcaaaagaaactaccatcagagtgaacaggcaacctacaraatgggagaaaatttttgcaayctactcatctgacaaagggctaatatccagaatctacaawgaactcaaacaaatttacaagaaaaaancaaacaaccccatcaaaaagtgggcraaggatatgaacagacacttctcaaaagaagacatttatgcagccaaaaracacatgaaaaaatgctcatcatcactggccatcagagaaatgcaaatcaaaaccacaatgagataccatctcacaccagttagaatggcratcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggaytataaatcatgctgctataaagacacatgcacacgtatgtttattgcggcaytattcacaatagcaaagacttggaaccaacccaaatgtccaacaatgatagactggattaagaaaatgtggcacatatacaccatggaatactatgcagccataaaaaatgatgagttcatgtcctttgtagggacatggatgaarytggaaaycatcattctcagyaaactatcgcaagracaaaaaaccaaacaccgcatrttctcactcataggtgggaattgaacaatgagawcacatggacacaggaaggggaacatcacacwcyggggmctgttgtggggtggggggaggggggagggatagcattaggagatatacctaatgytaaatgaygagttaatgggtgcagcacaccaacatggcacatgtatacatatgtaacaaacctgcacrttgtgcacatgtaccctaraacttaaagtataataaaaaaaaaaagaaaaaagaatc

SEQ ID NO: 4810 - DNA, 1800 bp, Homo sapiens
  misc_feature (1793)..(1796): n equals a,t,g, or c
ggtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatcttatgtttagctacatgaacttcgcaatttcatcggctcattctaatgaccacctaaaartcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcratgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatggattcctatgtatttcattaaaaaaaagtctcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggrttatagcaccatattttttgtatattccctatgtgtaactttttcctgttggtatgtgatawttttcatttaatatgactatctgcyggtgttggggccatagattgkggatatcctgtgggaggggccaaggaaaaggggatatatatatannnngggg

SEQ ID NO: 4811 - DNA, 927 bp, Homo sapiens
  misc_feature (697)..(697): n equals a,t,g, or c
  misc_feature (878)..(878): n equals a,t,g, or c
  misc_feature (906)..(906): n equals a,t,g, or c
  misc_feature (910)..(910): n equals a,t,g, or c
  misc_feature (920)..(920): n equals a,t,g, or c
tacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattwaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatwtttttttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagantgacacctggcatggcaagtctcattcacttcagcacaacactctgtacatttcagtctgatattctactttgccatttaaggacaccattaaaatcatagagattttcagtgacattggagtatggtaattattactttccaaaaattattttttaataagggtggattaaacccatggnggaggaaccccccttaaagggtaatttngccngttaacccgnatttaag

SEQ ID NO: 4812 - DNA, 664 bp, Homo sapiens
  misc_feature (663)..(664): n equals a,t,g, or c
ctagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaaaaaattatttttaataggatgattaaaccaatgagaagaaacacacataaatgatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctgtagtttatctcaatatattaataaaaaggtctgttctcactgtaaaaaaaaaaaaaaaaaaaactgaann

SEQ ID NO: 4813 - DNA, 473 bp, Homo sapiens
  misc_feature (346)..(346): n equals a,t,g, or c
  misc_feature (392)..(392): n equals a,t,g, or c
  misc_feature (425)..(425): n equals a,t,g, or c
  misc_feature (442)..(442): n equals a,t,g, or c
gggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctragtgtagctttgtatttatgtgtgtgtgtgtgtgtatgctgaattcacggtgnacttttgattatggggtgtgtggttgacggtgtgcttggtgcttgnctgctggtgggtcaaattggtactgacttaggnattctggctatggctgngggtacaaggaagtgctgtcagtcaagctgg

SEQ ID NO: 4814 - DNA, 1876 bp, Homo sapiens
  misc_feature (1867)..(1867): n equals a,t,g, or c
  misc_feature (1874)..(1875): n equals a,t,g, or c
accccaactcctcttccctgctcctttccctgtgttcaccctcagctctgacacattgwactgyagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttgcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaagtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgataaaaaaaaaaaaaaagggcggccgctctagaggatccctcgaggggcccaagcttacgcgtgcatgcgacgtcatagctctctccctatagtgagtcgtattataaggtagnccaagtnnt

SEQ ID NO: 4815 - DNA, 444 bp, Homo sapiens
  misc_feature (416)..(416): n equals a,t,g, or c
  misc_feature (419)..(419): n equals a,t,g, or c
  misc_feature (423)..(423): n equals a,t,g, or c
  misc_feature (442)..(442): n equals a,t,g, or c
tgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgktcamcctcagctctgacacattgaactgcagttggggggawtggcagttagccctctgtgcttctccctgcagccctaactctgccaaggtctctccctccagggaactctgcttccaaccacatatgtccaattaagtcaaccaaaattgaaaaagttcctggaantancttnttcccccaaacccagaacngg

SEQ ID NO: 4816 - DNA, 2490 bp, Homo sapiens
  misc_feature (1)..(1): n equals a,t,g, or c
  misc_feature (38)..(38): n equals a,t,g, or c
  misc_feature (60)..(60): n equals a,t,g, or c
  misc_feature (126)..(126): n equals a,t,g, or c
  misc_feature (252)..(252): n equals a,t,g, or c
naaaaaaagaagttttaataaaattaaagggaaaattncttaaaattccaaccccaattnacccctttaagcacgcccagaggtctcaagcccatttttggggccaatcaagtggcgggttgttgnccagcggagggcttccccaatcataagytcaaggccccaggaasccgccggcaggggtctgtggcctgtgccttggacaagctcctggccccacgccaggatggtcytgggcactggcccagytgncaggctgcggctcccgcctggtcagtggggataagggctaactcctagagcccaccccgaccccacacacccctcggacccacccacgtccccaccccggcctggacctccacgtctgccggccacagcctttcgtccacctccacaaaagcagctgtgtgtatgtacggggtgccctggcggcggtcctcaaattcccttcaggtggcagacagaacgagggtgacagtgaaaacgtgtccgcggcattggccctcggggaggaggcgaggggtccacccagcccgctaaaccctctccagggcataagccaggtggggcttctccaccggcctccaacgggtgggcaggccctggacaggcgacagggggctggaattacaaaggaattagcaccgacaacaggaagcgggtccttccttcctcaggcagcctcaggctggccggggagggggtgggggccaggcgcrggcgagacagtgcaagcctttgtcctcaggcaggtayggctgtgggcatgcagccgaggggcaggtggcaggcaggggatggcagccccctctgctttggcaagaggcagaatccagacactggcgggagagcgcctgcctgccgggcgttcctggctcctgctgcaggcaccacagagaccccaggccccgggtccccggggggcggcagagcaaagtcagggcagcccstgcgttcggcaggagaaaacgcgcgtgtccggggccctctcccgtccttccaccacagagctccgaggcagggccccgggagggagcgtgaacgctggcacggagacggcgaaggtcctgggggtgcgtggggtactctggaggggcaggacaggggtcagtcactgaagcacaggcaggagaccgcagttccgaggcggcagccactacacgaaggcctcctggttggacgagccgttgattttgaggaagagtttgtcatcctcctgcctctgctgcagctgccgctccagctggcgccggtagcagatcaggtagagcgggaggcagaagcccagcaggctgagaaggagcagccccacgttcacccacagagggtctccctggagaggacccatcatggccagaaacagcggctgctgcagaagggcgaagagcgcgctgatcagagactgcagtcccgtgaggctgccgaactgggtggaggggtacacggcagcgtacaggcccccgacagcggagtggatgaatcctcgcacgattgtgtgcaggatgaaggagaggatctggagaggcaggttgggaatgaggcaggtcaccccaaagcccacgagcagcaggttggtgaaggcgaaggcccgcatggcattagtgatcttctggatctgccggtcccgcttcttctttttcttctcgccttggttggcgtctttctcctcgggctcctcggaggcgtcttcacactccttcagcctccagtccatgatgtagccaatgacgggggccgtcagcaggcacagcagctggagcacgccgaagatggaggtgtagaggccaactgtcttctggtcgccgctgaccaggaacttgaggatgttgttcatagcccccatgtagaagatgagccgcagctgcgtgacgcacatggtgaccaggctgagcagcaggatggggcttgaacacgctgtgcatgaaggagggggccactgcggcatccggctggcacttcacctccaggtcgacggtggacaggcacagcttgtggccctcctgcagcgccacctgctccttggcactcctcatggagctgcccacactcaggcgccggcccaccgtggtcacctgcttgtagaactgcttccctgtgatcttgtggtcaaagcccagccagctgaacttgatcttcaccgagtagtccatgtcctccggccccgggaagggctcaaggggccagttaaagaagcagttgaggaaaaccagcccggagcagccggcccagaccacgaggacgacgatgaaggagacaccagcatcatagatgagcttgattcctggaaaggtgactgccgaggaggcgtaggacccaatcatcaaggcaataaacgtggaccgaaggtcgccgaacatgttgggcagtgttaatgaggtgaaggtcatacacatcccaccaaagccattcagagccagggcgatgaagatgagcacggagagagcgtttggtttacttgctccgtacgcaatcagcaagcaggaaacc

SEQ ID NO: 4817 - DNA, 3128 bp, Homo sapiens
  misc_feature (680)..(680): n equals a,t,g, or c
  misc_feature (3054)..(3054): n equals a,t,g, or c
ccacgcgtccgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcagagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtgncggcacctacaccaagggcgccttccagcaagccgcgcaaattcttcttcatgctagagaaaactcaacaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcacagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatatcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggtaattaaattctgtggcatcggtagttggcaagactaatctgcaaaataagaataattccagaaaagtgaggcaaactagaaacattaacttctattaatttattcatcaagtattttaggatggctaaataatttgataatgtgctgaaagatcattaaggttatatcaaattttagtaacaaataaattatttaaaattatttgccaggattcttaaaaatgacaaaaactaagaaaactaagtcacatatgctggtaaaattcaantgttgatgtatcctaaaagagaatagtaataaagtcctaacagcaacttttaaaaaaaaaaaaaaaaaaaaaaa

SEQ ID NO: 4818 - DNA, 1696 bp, Homo sapiens
  misc_feature (731)..(731): n equals a,t,g, or c
  misc_feature (1691)..(1691): n equals a,t,g, or c
gacactatagaaggtacgcctgcaggtaccggtccggaattcccgggtcgacccacgcgtccgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgamctttcagcagatgtccccgtcgcgcaatttcagcttccgcctcttccccgagaccgcgccsggggcccccgggagtatccccgcgccgcccgctcctggcgacgaagcggcggggagcagagtggagcggctgggccaggcgttccggcgacgcgtgcggctgctgcgggagctcarcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtgncggcacctacaccaagggcgccttccagcaagccgcgcaaattcttcttcatgctagagaaaactcaacaaaagttgtatttctcatcactgatggwtattccaagggggagaccctagcccaattgcagcgtcactgcgagattcaggagtggagatcttcacttttggcatatggcaagggaacattcgagagctgaatgacatggcttccaccccaaaggaggagcactgttacctgctacwywtttttgwagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtytacccaatggtttgtggtccggttcagagagctactgcagagtaagaacatgtcctcatctccgccagccgaaacatgggccacatcagctgttcttacaagggaaatgttatataaggacaacatgtttggttgcctgtgatgaagggtacagaytaggaagggcagtggwtaagsttaattgttcaaggganacagg

SEQ ID NO: 4819 - DNA, 950 bp, Homo sapiens
  misc_feature (906)..(906): n equals a,t,g, or c
  misc_feature (920)..(920): n equals a,t,g, or c
  misc_feature (922)..(922): n equals a,t,g, or c
  misc_feature (940)..(940): n equals a,t,g, or c
ctctgagctcctgcagacatatggatcaatcaggccttcgcsctgttcgcttgctgcgggaatgttracagcctgacagacgcggggttctgktgtcatggaatctccgacctttggcttgatcccgggagragaatgagagggggaggagggagatagagtcacagatacagraagtagacaggagcggggagagggagagagggagagaaggagggaagcgggagatttttcttgactgccccctttccttcaaacattttataggcttcagggagagagaggaggaggagagagggaagaaaaaaagaggagagcgagaggggtagagagcgcgcgccgtttccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgamctttcagcagatgtccccgtcgcgcaatttcagcttccgcctcttccccgagaccgcgccsggggcccccgggagtatccccgcgccgcccgctcctggcgacgaagcggcggggagcagagtggagcggctgggccaggcgttccggcgacgcgtgcggctgctgcgggagctcaacgagcgcctggagcttgcttcctggtggatgattcgtccagcgtgggcgaagtcaacttccgcagcgagctcatgttcgtccgcaagctgctgtccgactttcccgtggtggccacgggcaccgcgtggncattcgtgaccttntngtcaagaacctacgtggntgccgcgcgt

SEQ ID NO: 4820 - DNA, 546 bp, Homo sapiens
  misc_feature (478)..(478): n equals a,t,g, or c
  misc_feature (524)..(524): n equals a,t,g, or c
  misc_feature (538)..(538): n equals a,t,g, or c
  misc_feature (541)..(541): n equals a,t,g, or c
ggttccaaacagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgscagccacagtggcagctcttggaccccaatgccacggccaccagctggagcgaagctgacacggagccgtgtgtggacggctgggtctatgamcggaggtcttcacctccaccatcgtggccaagtgggacctggtgtgcagctccaaggcttgaagncccctaaccagtccatctttatggccgggatcctgggtgggctccnttatctgggggctnctnttcta

SEQ ID NO: 4821 - DNA, 1133 bp, Homo sapiens
ccacgcgtccgatttgtataaagagtgactctcctatgaaggtaaaggccacccctcttcagttccagtgactgagatacatttttccaatcctgggggcaaatacagacacagcaagttccttcttccctttggaaatttggcagctgccttcaccagtgagcacaaagccacatttcaaaggaaactgacaaattatccccagctgccagaagaagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgcccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaaaaaaaaaaaaaaa

SEQ ID NO: 4822 - DNA, 1148 bp, Homo sapiens
  misc_feature (820)..(820): n equals a,t,g, or c
atcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcagctgccttcaccagtgagcacaaagccacatttcaaaggaaactgacaaattatccccagctgccagaagaagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagccagaaggatgagaaatgctacgaggtgttcagcttgtcacagtccagtcaaaggcccaactgcgattgtccaccttgtgtcttcagtgaagaagagcatacccaggtcccttgtcaccnaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaaaaaaaaaaaaaaagggcggcc

SEQ ID NO: 4823 - DNA, 1149 bp, Homo sapiens
  misc_feature (146)..(149): n equals a,t,g, or c
  misc_feature (927)..(927): n equals a,t,g, or c
  misc_feature (1077)..(1077): n equals a,t,g, or c
  misc_feature (1083)..(1083): n equals a,t,g, or c
aaggtggatttccttccaactatctcagaaagaagccgtagccgactccctttctgcctagagggcccgctggtccttgctggctttacccacgtatttaatacgcctcttaatttatcattctccacgcagcttccaaggcagannnnctctggggtactgtgacttcttgcctcccatgggtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcactttgctgctgcaggctccggtccctycagggcttttcaatgagagttcccaccccaacttggagcatttcatttttgsctacctwaagcaagaatctcaaagtttggttgaataaraaggccattcacaagtcgtgcccttgtgaagcaccccttttgytgaatgsctcgtgggtgnccaaacactgkacttggcgctttgcattcatgctttgaccctcacaacctccctttatagatgaggaaattcacgctccatgtgcccaaggacacaccagccaggaggaagagggaagaggatttgagtccaggcctgcctgacttcagngcctgngccctcccctctgtaaaagacaaaccaggcagggaagagatagaagctggctaagtggtggccaag

SEQ ID NO: 4824 - DNA, 1767 bp, Homo sapiens
  misc_feature (8)..(8): n equals a,t,g, or c
  misc_feature (11)..(12): n equals a,t,g, or c
  misc_feature (34)..(34): n equals a,t,g, or c
aggatccnacnncaggttgaacctttccgggaanctacccgaccgaggcagccctgccctgccctgccccgcccctcctcaccctgcyctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcaacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcgsggtgsccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcccttaatccttacggcaagcctgtgaggcggataggaccagccctgatctatagtgagaaaattaaggttcagagggagaaggtccaaatagtggccaagctgggactgagatctcgagtttgggtttgtttgggttttgttgttgttgttctttccctcgtgtccatgacttttctctgccattagcarggaagtgtgcggagggcttccaggggaatcaagtgaccctccctctgaatttcggtgcctcttccccccgccccttgctcacacatttcagtaggtcacaggccaaatggcagcccaaaaggtgggcagagatttttttttcttcccctcacccctrcttattaacacaattgtgacaactactttaccttacatcccagggcaaacggacagcttgcggtacctccaaaaatttggaaaaccctgagtctaagaccacctcttgataaaagaggcctttgctcacatgttctgctcggaatctttctttgccattggtgggtgtatgtcgcccagctgagactkcgggagagytgagttcagcttaaaccgc

SEQ ID NO: 4825 - DNA, 555 bp, Homo sapiens
  misc_feature (545)..(545): n equals a,t,g, or c
tccctgcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgkttttttcttttttcacgcactgccaaatctgttttctcccttgaagaaacccagggcagatgtggtccgtctgtcaaactgaggtctggagaggcatgactaaatcactgcagaagcaaaatcaggacccagcatttctagctcccagcccagagtaagagagcagagcagaaccccttcccattctacccgaccgaggcagcctgcctgcctgcccgccctccccaccctgccctgcccagagatctcagttacagtgtcatcaggcgagatctttggacccacaaagcagktttttggggggatgctcagtgctacctgcagtgccaaagttttgcttgaacagcccttttttgccggctccagntcacccctat

SEQ ID NO: 4826 - DNA, 2635 bp, Homo sapiens
ccacgcgtccgggcgaccgcgcgccgcccgccctcgcccgcctttgaagtttgctgtgccgaccgcaaagttgggacacttcagcggattgaatttttctcttttatctgcctccgtccccgccctccaggcttctcgttcctggatattggtgcttagcatcttggcagggtccggggacgtggactatttcgcacaccacaccacggggagggatttttttctattttccctacgaaaaacagatctttttaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaaaaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatccggtttgtatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaagaacatcttcaccgtctctgatctgaaacccgacacgcagtactactttgatgtatttgtggtcaacatcaacagcaacatgagcaccgcttatgtaggtacctttgccaggaccaaggaagaagccaaacagaagacagtcgagctaaaagatgggaagataacagatgtatttgttaaaaggaagggagcaaagtttctacggtttgctccagtctcttctcaccaaaaagtcaccttctttattcactcttgtctggatgctgtccaaatccaagtgagaagagatgggaaacttcttctgtctcagaatgtggaaggcattcagcagtttcagcttagaggaaaacctaaagctaaatacctcgttcgactgaaaggaaacaagaaaggagcatctatgttgaaaattctagctaccacaaggcctactaagcagtcatttccctctcttcctgaagacacaagaatcaaagcctttgacaagctccgtacctgttcctcggccaccgtggcttggctaggcactcaggaaaggaacaagttttgcatctacaaaaaagaagtggatgataactacaatgaagaccagaagaaaagagagcaaaaccaatgtctaggaccagatataaggaagaagtcagaaaaggtcctctgtaaatatttccacagtcaaaacttgcagaaagcagtgaccacagaaacaattaaaggtcttcagcctggcaaatctttacctgctggatgtttatgtcataggacatggggggcactctgtaaagtatcagagtaaggtttgtgaaaactagaaagttctgttagttaccttcttatagagatatattatgtagaactccaggagggacattaaatcactttaagtataaactgactactcccacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaaatcattcctctctatagatgctaggatatatataaattattttataaattcttgttttaaatgtcagtgtttctatgattgtaaactattaaattcttttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtacataaaattaaagagattaaaaaaaaaaaaaaaaaaaaaaaaaaaaaaaaaaaaaaaaaaaaagg

SEQ ID NO: 4827 - DNA, 2100 bp, Homo sapiens
gagatgtggattctgaaataagtgacttggagaatgaggttgaaaataagacggcccagatattaaatcttcagcaacatttatctrcccttgaaaaagatattaaacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggatgaattaaaccttgctgattctgaagtggataaccaaaaacgagggaaacgacattatgaagaaaaacaaaaagaacacttrgataccttaaataaaaagaaacgagaactggatatgaaagagaaagaactagaggagaaaatgtcacaagcaagacaaatctgcccagagcgtatagaagtagaaaaatctgcatcaattctggacaaagaaattaatcgrttaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaaccwgcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctgattatatttagttttgcttttccagatattacattctatagttaccaaaaatggtkgaagggagggatttctcattgcagagggtggggtgcaagggaataagacacttgtacggaacactggaagctttgccaacttctacacatgccttttttgcagtcctttaactgtccaccctaccaagagcttataaccagtatcagaactggrtaatgacgcmgtttttcactcygacctccatcatgcttgcctgatttaaaagccctcagtttgcagtccagggactgttcaggcttgtcctcagctgagaggacacaggctagagggactgtgcagaaccaggctgggagaagggctgggaaaactgggagtggagggtggatcctcatggagcaggagagtagctcatggttccagaagccctgaggccatgca

SEQ ID NO: 4828 - DNA, 1126 bp, Homo sapiens
ggcacgagcggcgccccggctgcttctgctctttctggttccgctgctgtgggccccggctgcggtccgggccggcccagatgaagacctyagccaccggaacaaagaaccgccggcgccggcccagcagctgcagccgcagcctgtggctgtgcagggccccgagccggcccgggtcgaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccaaaaaaaaaaaaaaacaaaaaaaaaaaaaaaaaaagggcggcc

SEQ ID NO: 4829 - DNA, 1583 bp, Homo sapiens
attcggcacgaggaaacctgctgctttcacagaggaaggcatttgctggctttcccaaggcaagaacaatgaaaacaaagtcatgaggagttctctctacctcaaatgaaggccgcagctcctgctcaagctattttggcagtctgagagaacagtacattctgaaccacattgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaaattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaaaaaaaaaa

SEQ ID NO: 4830 - DNA, 1444 bp, Homo sapiens
gaattcggcacgaggaagaatctgagagaaacctgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaaattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaaaaaaaaaa

SEQ ID NO: 4831 - DNA, 1892 bp, Homo sapiens
attcggcacgaggaaacctgctgctttcacagaggaaggcatttgctggctttcccaaggcaagaacaatgaaaacaaagtcatgaggagttctctctacctcaaatgaaggccgcagctcctgctcaagctattttggcagtctgagagaacagtacattctgaaccacattgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtatgctcccgctgaataaggaggaaaggaggaaaaacaaggaactcaagatattatccatgattcttcctttaatatatctgtgtttgaacccaactgtatcccaaaaccaaaattccttctatctgagacctgggttcctctcagtgttattcttttgatattagtgatgctgggactgttgtcctctatccttatgcaacttaaaatcctggtgtcagcatctttctaccccagcgtggagaggaagcgcatccaatatctgcatgcaaagctgcttaaaaaaagatcaaagcagccgctgggagaagtcaaaagacggctgagtctctatcttacaaagattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaaaaaaaaaa

SEQ ID NO: 4832 - DNA, 1439 bp, Homo sapiens
  misc_feature (1281)..(1281): n equals a,t,g, or c
gaattcggcacgaggaagaatctgagagaaacctgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggsacagggatcgtcatcttgggacacgtagaaaatatttttcacaactttaaaggtcycctagatggtatracttgcaacctaagggcaaagagcttttccatacattttccactttkgaaaaaatatattgaggcaattcagtggatttatggccttgccactccactaagtgtatytgatgaccttgtttcttggaaccagaccctggcagtctctcttttcagtcccagccatgtcctggaggcacagcyaaatgacagcaaaggggaagtcctgagcgtcttgtaccagatggcaacaaccacagaggtgttgtcctcccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaaattcatttctggcttccagtcctgaaaatgattaggaagaagcaaatggacatggcragygcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatytntaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaccg

SEQ ID NO: 4833 - DNA, 3338 bp, Homo sapiens
  misc_feature (2861)..(2861): n equals a,t,g, or c
  misc_feature (3328)..(3328): n equals a,t,g, or c
  misc_feature (3330)..(3330): n equals a,t,g, or c
taccgggacattctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagataacttcataaccagaattgtctgttggctagcagctgtcacagataggcagggcacttgggatatgacctttctgtccaggtgattcacagactagacctttcttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccracatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggnttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcattttatatttgtcaatttaaatcttatgggtctttttttttttatctctcttgatgtcagattttatagtctttttaaataaatccatttaattaaaacgttaaaaaaaaaaaaaaaaaaaaaaaaagggcggccgctcgcgaatctagaactangncccacgcg

SEQ ID NO: 4834 - DNA, 2170 bp, Homo sapiens
ggcacgaggtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtctgatgaattcttcaaagaactacttgaaaatgcagagaaatccctgaatgatatgtttgtgaagacatatggccatttatacatgcaaaattttgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtccgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgtttctcattcagttttgggaggaaaagggactgtgcattgagttggttcctgctccccaaaccatgttaaacgtggctacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaaaaaaaaaaaaaaaaaaaa

SEQ ID NO: 4835 - DNA, 1373 bp, Homo sapiens
  misc_feature (1373)..(1373): n equals a,t,g, or c
gaattcggcacgaggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaaggaaaaaaaaaaaaaaan

SEQ ID NO: 4836 - DNA, 1076 bp, Homo sapiens
  misc_feature (459)..(459): n equals a,t,g, or c
gaagaaactcacctgccccatcccagtgcattctgaacatttcttatttttatcttcttaccaaccttctctcttaaaatcagcttcattaaaatggatttttctagagtaaccaccagatcacctcccccactctcagtccgttttccagtcaaaccatttgttacttgattcagttccaaatataatgtgtgtctgctactgttaagtcattgccttatagtcaacctcaagggtagtcataaactccaagagtttcacgtgtctgactatattcttaggagattgatgggttacatttttctcctcgatagtggtcatggggggaaatgtgttaatttttcactttagatgtttgtggaaatgttggggaagagtgaggggtttgttcttaagtggtgggccattgacccaaagtatttttaattcccttttttaggctgcatttgatgccagaangsaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaaggaaatgcgattttaaaagaagaacgcg

SEQ ID NO: 4837 - DNA, 553 bp, Homo sapiens
aaggaataaagcctctaacttcaatagctakgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctccyggttcacttttgagagatgaatactttgggccagtaaaggtgaacaaaatatgtattttcatcactctgtactaaaaggacaggaatgtwattaattaaaacactmaagcagaaatcctacattgctattaaaattaaactttgawtaccacaataaaaacagtagcaagttaaacaaaaaaaaaaaaaaactcg

SEQ ID NO: 4838 - DNA, 1607 bp, Homo sapiens
tcactaaagggaacaaaagctggagctccaccgcggtggcggccgctctagaactagtggatcccccgggctgcaggaattcggcacgagatgagccactgcacctggcctctagactacagttttttatttatgagttgcgcctccatctgtgggcagcacggagcctctgtaggcaacacagggaggaagcaggtgcagatctggctgggcctgcttgcctggcaattgggaaagccaccccttttatggctcctcccccgtcttttcatgactgttgcagctcaccagctgcagctgtagagtagagcttcttcctctagaagggagctttcctccctctgctaggacttgggggaggcttatggaccctcactttgggagctatgagccagggctgtgccaagcatctcatgagctcaagtgcctgccactgcttgacctgcttggtctactggcattgtgattgggtcaggcccagtgactctgagttggctggaagacactcagatttagtgaggactcattatagccaccactttcggtctagcctgggmctggagggacggatgtrggcataccctgagtttagacaggtagccccggsccctttcagagtttctctgtgagtccccttagarctttgtttcaaaggctgggaagctgttctgtcctgccttggcagtccaggactgggtgtgtggtgcggggaggtggaagtccgtgcacccctaggggctttccttgcctcaggggtcccccagccaggccacagcaggsagagctgaggycctacagtcagtctgagaggystscctgctttcagatacagggtggggtgatgggtgaccatggatcctgaacaggccagaggccctgttcccaagttgcagcttttacttcctggaggcctccctgactgccgggtgtttgtgttgttcacattcctgtgtatagggactccgcctccatctgcagcctcccctcgtgccctgtctccagcacgcctggctgcccaggtcagcgcacatgcaagtgggtggaatgaggccacggctggctgaacgctggtctgagcttaggaaaagaaaaactggtacacagttcagtgtcataaaagggaaagcagaacatgtcatctccgagttgccaacctgctgactcactttagactaggtcagtgcccacaggcctgatcagcacttggaggatggtagagtttacaggcaaggaagcatcataaatcaccctgtgggtatgtgccgccttactccctggtgaggaaagcaaaaaaaacaaaacatagcttggatgtgtggttcccagatgtagcaaaaataaagagaaacaataaaagccaaggcaagcaaactgggcaacatagcaagaccccatctgtataaaaagtggaaacatttttagcccaggcgtggtgggacgtgcttgtagttccagctatgcaggaggctgacataggaggatcacttgaacccaggaggtggaggttgtagtgagccaagactgtaccamtgcactccaacctrggtgacagaatgagaccctacttcaaaaaaaaaaaaaaaaackcgagggggggcccgggaccc

SEQ ID NO: 4839 - DNA, 753 bp, Homo sapiens
ggcacgaggtgatgacttcactcccaattctggcatttggggctgtctattggccagaccttgcttcacatagtttctcaccctcaaggagtctagcccagactccccatatgtcagtctcagggtagcatttcaagagggataaggtagacgtttctggcctgttgtggtgtaggctgtgaattaccataacatcacttctttgagattttcttggtcaaggcaaatcacatgacaaggactcaagagggtagagaaataggttctactatttagtggaaaggacagcaaagtgacatcacaaagaggaatgcatatagagatggggggaatatgtgaccaactttagtaatcactgtaattctgaattgactcacaaacactatcaagacggatcattgtcataccctagttcaaaaagcagtccttgcagcaatacagaacagatagaagtgaagagaatgtgattttgctaaaaatgacatatttacatgaccagtgatgggtgagacctatgaaaaatccccagagattctcaagaactcataaagtgcatttccatatttatgtagaatatcaatctcctgctgtctttgacttcacctagtatattcctaggtatgtgtatctaagcccaagttggtctcacgtttttgcctacttccgagtcaatatgtgacatgccatcccacctttttgtgttaccacattattataacataaggggtggttatgtttcctggatatcttgag

SEQ ID NO: 4840 - DNA, 612 bp, Homo sapiens
gggatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtagtggggcagttcaccaagtgtgagatcgacatttaatgttttcatgaaatgcaaacccatcagtggctaatttgttaaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgyccaaggttgcatcatcagagtgtcgttatgaaaaaaaaaaaaaaaaaactcgta

SEQ ID NO: 4841 - DNA, 430 bp, Homo sapiens
  misc_feature (352)..(352): n equals a,t,g, or c
ggcagaggaagggagctgtggggcagcggccaggaccttaaaggcacagaagaggaagcttggatttccaattccaaaggacatgaggaaaattcacacacctttatttaacctgctccaggtgaggctgggctttgtgtattttccttgttttacttttccttgwgttcaggctgttgtagaaacaggtacacaggggctctgtgtggcgccctgttctagttgccttcaggaagcatgtggtgccctggtttccttggcttcgtgtccccctttcctcctgccacccctgactctgccccccaccttgtccctcagaacatcttcctggaagggcctggccagggcttgngtccttgctagtctctggggaggaagactctgtggcttgaaaggctgtcggcttaagttgcaaggtgtaggtgcctgg

SEQ ID NO: 4842 - DNA, 2203 bp, Homo sapiens
  misc_feature (1246)..(1246): n equals a,t,g, or c
  misc_feature (1846)..(1846): n equals a,t,g, or c
ggcacgagcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggaraacaggcagtggcagtgtgaccaagaaccatgcctggtggatccagacatgatcaaagccatcaaccagggcaactatggctggcaggctgggarccacagcgccttctggggcatgaccctggatgagggcattcgstaccgcctgggcaccatccgcccatcttcctcggtcatgaacatgcatgaaatttatacagtgctgaacccaggggaggtgcttcccacagccttcgaggcctctgarartkkyccamcctgwttcawsagcctctwgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgttccaagccctcatggaggtgcatgaggacttcttcctataacaagggargcatctacagccacacgccagtgagccttgggaggccaganagataccgccggcatgggacccactcagtcaagatcacaggatggggagaggagacgctgccagatggaatgacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaaaagcacagctgcagatcccaggcctctggcgcccccactcaagactaccaaagccaggacactcaagtctccagccccactaccccaccccactcctgtattcttttttttttttttttagacagggtcttgnctccgttgccccaggttggagtgcagtggcccatcagggctcactgtaacctccgactcctgggttcaagtgaccctcccacctcagcctctcaagtagctgggactatcaggtgcaccaccacacctggctaatttttgtattttttgtaaagaggggggtctcactgtgttgcccaggctggtctcgaactcctgggctcaagcggtccacctgcctccgcctcccaaagtgactgggattgccaggcatgagccactgcacccagtccctgtattcttattcttcagatatttatttttcttttcactgttttaaaataaaaccaaagtattgataaaaaaaaaaaaaaaaaaa

SEQ ID NO: 4843 - DNA, 638 bp, Homo sapiens
ggcacgagagaggtcctggggtaagagaaaaaaagtagttatagcacttcgtccagcactgacagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaa

SEQ ID NO: 4844 - DNA, 1928 bp, Homo sapiens
ggcacgagagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaaa

SEQ ID NO: 4845 - DNA, 1714 bp, Homo sapiens
ggcacgagaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaaaaaaaaaaaaaaaaaaaa

SEQ ID NO: 4846 - DNA, 1355 bp, Homo sapiens
gggtaagcgcgtctagggcgctgcgcggcgcacgaaaatggcggcttccaggtgggcgcgcaaggccgtggtcctgctttgtgcctctgacctgctgctgctgctgctactgctaccaccgcctgggtcctgcgcggccgaagctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaaaaaaaaaaaaaaaaaaaaaaaaaaaaaaaaaaaaaaaaaaaaaaaaaaaactcga

SEQ ID NO: 4847 - DNA, 960 bp, Homo sapiens
caccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttaaaaaatgtcagtgttaaagaatggtaaaa

SEQ ID NO: 4848 - DNA, 1419 bp, Homo sapiens
ggcacagccaggaagctggtgcgtgtgcagcctcgggagcgccattccacgcacacttgcgtgccggtggccttgttatgtcgttctttttttgtctacactgtttgagtgcttttccatcattgaaagggcttcattacagtctcacattttcccttttttttgcctaatgctaatggtcagactttttaacagttttccacatgctcttctgatccttttcctctggggtgagcagtcaccactcaccaaaccctgccccacccattgggcacctgtctggatggtcccaggaccgcaggtgctgtggggcacccattggggacttccaggaaatcatttctgcaggatccgttcgcacacacgaagagcacagtgccctcgggaagggccctttccgaccacgctgccccactggggttgggtcaccgggacatacagaggctggtgctgcctggcttctcctgcctgcggtgggagctgggttttgctcccgtttggttttgttttctacctgtcaggctgggcgtctttctgagggttccctgaccggcctctgaattgattgtttgtccacgtgggcctggaagtttctcttaaagactaaatgcccctcactggggaaacgacgctgtgccatgttcacagcagacactcaccccagtgggcctccctttttctctggtcacgttggttacttcataggcctttaggttttgatctgtgtttatggaccacggcacttccttccttccacagtgcggtcagacacaggctttgtgtgtctaacgacagactgtttccagtagtttttctaatacttacgttttaaaattttaaataattcacttgttttttggcattgaaaatatttcattcataaatagtttctagttatgatttaaataattttcccatttttgactgtagtttcccagaatcctctttagaatctcagtccttgtgtttgggtcttctccgcgtgccattacctcacctctgttttgtgccacacactctttaaaagkgkcttcccgcggggyttagagwtaggaaagtcgcgcacacataggacagagccccagccgcccctcgtggcacccctcccatcccaagggtgcgtttgtcgcagctgggaacccagtgcagcaccccactcagctgctggtttcactgtctcrtcattggtggttagactcaagkagtgtggggtatgtgaatctgcctttcagattctcctgatcttttaagcgaatgacacaaagtcaggttttaacaatatcgtgctaactgtgttttctcaggctgttacacctggtgcttgatatggatttgacttgtctattcttttttttttgtttttcttttttctttaattctagaaccacgttcgtttgaagtaggaatgctagtctggca

SEQ ID NO: 4849 - DNA, 459 bp, Homo sapiens
  misc_feature (421)..(421): n equals a,t,g, or c
ggcacagccaggaagctggtgcgtgtgcagcctcgggagcgccattccacgcacacttgcgtgccggtggccttgttatgtcgttctttttttgtctacactgtttgagtgcttttccatcattgaaagggcttcattacagtctcacattttcccttttttttgcctaatgctaatggtcagactttttaacagttttccacatgctcttctgatccttttcctctggggtgagcagtcaccactcaccaaaccctgccccacccattgggcacctgtctggatggtcccaggaccgcaggtgctgtggggcacccattggggacttccaggaaatcatttctgcaggatccgttcgcacacacgaagagcacagtgccctcgggaagggccctttccgaccacgctgccccactggggntgggtcaccgggacatacagaggctggtgctgccttgg

SEQ ID NO: 4850 - DNA, 660 bp, Homo sapiens
  misc_feature (3)..(3): n equals a,t,g, or c
  misc_feature (559)..(559): n equals a,t,g, or c
  misc_feature (592)..(592): n equals a,t,g, or c
  misc_feature (645)..(645): n equals a,t,g, or c
  misc_feature (649)..(649): n equals a,t,g, or c
agnctgggaactgtggatccaaggctgcccccaccccctgggtctcgctcacatctgcactccccagagggrcaggtggtcctggagcctagcctacctgccgagagtcagaggtggctgcaggggaaccatggcagccctccttctcacactcatcctgggcaccctgcaccagcagaagggtttacatgtacaatcacccatccctagccccttctggggaggggaagcatatcttacggatggcgaccttgaggctcagggaggttaaggtgccagcctgagatcacacagccagtgagaggcagagacagggcttaaactccagacgatggctccagagccccctctcttttccatgcctgggctgcctctttcccartgcaccttgctttttggaaccagatgaccaatgtggaaagacatgaactgattcaatcagagtgtatggagaagggacttatataccctggtatttttaaagctccctgtctctagtaaaaatacaaaaattagccaggcgtagtggcaggcgcctgtaatcccagctactccagangctgaggcaggagaattgcttgaacctgggaantggaggttgccgtgagccagatcatgccactgcactccacctgggcaacaaantganactctgactcc

SEQ ID NO: 4851 - DNA, 537 bp, Homo sapiens
  misc_feature (110)..(110): n equals a,t,g, or c
  misc_feature (480)..(480): n equals a,t,g, or c
  misc_feature (524)..(524): n equals a,t,g, or c
caatccatatgaaatgtggtggtggattcagctgaaaccatggaatgaatgggggcgaggctggggatgtggaaactgtatcccagggatcagatctagacgactcagtngatgattgcatggggtgcaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcanggagggcgcataaggcctccactgctctgagcacctgctcttanagaaagctcccag

SEQ ID NO: 4852 - DNA, 737 bp, Homo sapiens
  misc_feature (255)..(255): n equals a,t,g, or c
  misc_feature (695)..(695): n equals a,t,g, or c
  misc_feature (710)..(710): n equals a,t,g, or c
  misc_feature (733)..(733): n equals a,t,g, or c
tgagacagagtctcgccttgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacctgtctcagcctcccaaagtactgggatnacaggcgtgagccaccatgcctggccagaaatctatgttttcttagaacatgtggaagaaggaaaaagacaaaaaaggaagtctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccatacatccagcatttctttatggatatacaancaaatgggaatgtanagtctcacatttctctctttatnccca

SEQ ID NO: 4853 - DNA, 1767 bp, Homo sapiens
  misc_feature (135)..(135): n equals a,t,g, or c
  misc_feature (1140)..(1140): n equals a,t,g, or c
  misc_feature (1571)..(1571): n equals a,t,g, or c
  misc_feature (1683)..(1683): n equals a,t,g, or c
  misc_feature (1701)..(1701): n equals a,t,g, or c
  misc_feature (1741)..(1741): n equals a,t,g, or c
  misc_feature (1747)..(1747): n equals a,t,g, or c
gctggaagcagcgtcttattttaccttgttctcccacttcctgaagatgctaaactcctggtggactgcagaggagagggattcagtcttctcctgatgtgtttgcctgtaggtacctgagttgacaccgaagcnctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttyctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactycccgagtgaytgtgtcaaaggacaggcaaagttttggacccatcatggtgtaccagaccaangtctyctgtgcctytyacctgtcccagcagctgtgtctgcacctctcagagctyaracaatggkctgaatgtaaactgccaagaaaggaagttcactaatatctctgacytgmagccmaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgnttctgaacaacaaccttcttcggtccttacctgataatatatttggggggacggccctaaccaggctgaatctgagaaacaaccatttttctcacctgcccgtgaaaggggntctggatcagcttccggntttcatccagatagatctgcaggagaacccctgggactgnacctgngacatcatggggctgaaaga

SEQ ID NO: 4854 - DNA, 3580 bp, Homo sapiens
  misc_feature (1580)..(1580): n equals a,t,g, or c
  misc_feature (1692)..(1692): n equals a,t,g, or c
  misc_feature (1710)..(1710): n equals a,t,g, or c
ggcacgagctggaagcagcgtcttattttaccttgttctcccacttcctgaagatgctaaactcctggtggactgcagaggagagggattcagtcttctcctgatgtgtttgcctgtaggtacctgagttgacaccgaagtactctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaattaggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactccccgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgnttctgaacaacaaccttcttcggtccttacctgataatatatttggggggacggccctaaccaggctgaatctgagaaacaaccatttttctcacctgcccgtgaaaggggntctggatcagcttccggntttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcaagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctcctttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaacccaaaaaaaaaaaaaaaaaa

SEQ ID NO: 4855 - DNA, 1905 bp, Homo sapiens
  misc_feature (681)..(681): n equals a,t,g, or c
  misc_feature (1268)..(1268): n equals a,t,g, or c
  misc_feature (1891)..(1891): n equals a,t,g, or c
  misc_feature (1893)..(1893): n equals a,t,g, or c
  misc_feature (1899)..(1899): n equals a,t,g, or c
gaccgagttttttttttttttttttgggttaaatatattttattaatgaattattaatcctgactgaggtggcttattacctctagtccactgttaaatccccttagttgacttaaataaaatcacttaaacccagaggaaaggaaatattttatagttaagcctacaaagtcctagaactagaatcatttgatgacaggctggtttctataactcaagcaaactgtacgttgacttaatatagctgacacatcaatctattttacagtgttttcaatttcaaaaatacaacacattaaaatattttcaatttatcaaagctaaaagcaacatttaagtaatgtacttaaagtgcgaaggccttttaacacaaagtagtgatacccagtggctatactcggtaactgacgatggaaataccatatatcattatttacaaaagaagttgtagtcacaaaagatctttggagatcttctacaaaatacactaaatatccattttcatttgaaaagtttgcctattctttcttcagtcactataatctcctcttcccactcccacactgaaaaacaaagaagaaaaaagaaacaaaaccataaacaaaatctatgaagaaayscattsyagaaacattcatgtccactgatggttcctaagaagagaagggaaaaagaaaaaanwwaaaaaaaaggaggggaggagagcgagagagaaataatttaaaggaaaacttgcaaaagcaaaatcatgacttcatcctatctcccaaacattttcaaagtcccccattaacactgggaaagggagaacaaaaacaaacacaaaagctaatgtccttgtttccaacagttcggagcagcatcctctgatgccttagggttgtaaatgatttcccttcacagctgactgattgcagtttgtttttccagaacttcgaggtagtccggttctgattgcggcttagcttgcagtaaagggtggttgggttttgactgccccacaaagcatttcctgggagttccatataaaacggttttattgattctgtcttggttttggcgtcgagattcataggaaggggcaaactgccttttaggtaaggtacaaaagttatagtggactaggcctgcgctgggaagttccttgactcgctcagcaatattttgatacagcagctcaggctctcttggtgtggcctgcttttctagcagctcagtggcacttattgtgtaagcaggtgtggctggctcttcttttttctcctccnaggttgctatagctgaactcttgcaggtttcggtaataggctactgggtctccttccttctgcatgtagatggggttttggcacatctgaccacaggtggggggatatagttgtagacatggccgtctgttttatcgtgagtctcagtgttgtaagacccatactgtaattgaaaggagcttacgtctaagttgttggtattcctgggaacgctcggcactcctttcggcgtttcaagacaaagacgaataaaccagccccaaaacagacagataagatgaaaacaacaagcaatcccagaattaagacagacagtggaacttcagtgtgtagttcaggataggaactaggagacacactaagcgaccgaggtgtgtctgtattgtgattcattgacaagacggttccatctgacaagtttgggctgtctggacagatagcctccctccccagaaattttagtatctcccctgcatgcttagcaggagattcgcaagtcacctcattaatgatgacaggggaattggcatgttctgtccagtctttcagccccatgataacaagtacagtcccaggggttctcctgcagatctatctggatggaagtggccgtaacctcaaangngctttntatttt

SEQ ID NO: 4856 - DNA, 1018 bp, Homo sapiens
  misc_feature (922)..(922): n equals a,t,g, or c
  misc_feature (957)..(957): n equals a,t,g, or c
  misc_feature (976)..(976): n equals a,t,g, or c
  misc_feature (984)..(984): n equals a,t,g, or c
  misc_feature (992)..(992): n equals a,t,g, or c
atttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagsccttgggccagggtgtttggcggcacaggggcatccgstgggatggcctggaagaattgggggarggggaacgtcttcactggggtggtgatcagtgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccatttnttttttttttwaatttggagtgggagggagggggntgggcgagagaaagctcgnaaggtatnattgggtnttttcaaaaaaattagaggtgacgga

SEQ ID NO: 4857 - DNA, 1779 bp, Homo sapiens
  misc_feature (3)..(3): n equals a,t,g, or c
  misc_feature (6)..(6): n equals a,t,g, or c
  misc_feature (11)..(11): n equals a,t,g, or c
  misc_feature (16)..(16): n equals a,t,g, or c
  misc_feature (26)..(26): n equals a,t,g, or c
tcncgnggggnactcncttcttcctntatgatcctccaccccatttttttttttttttaatttggagtgggagggaggggggtgggcgagagaaagctcgaaaggtattattggtttttcaaaaaattagaggtgacgattctaccagggagttgactgataggagtgtgtgcaggsaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgktttaccactccatcacctctcaacctttgcttcgacaggtcttcacttacgatttattccttcagggctttgattggagagagtaactttttaatctggtggtttgcmgtttggctctgtaggaatgagtggcgattcaaagatgcccgggcgtcccg

SEQ ID NO: 4858 - DNA, 1175 bp, Homo sapiens
  misc_feature (459)..(459): n equals a,t,g, or c
  misc_feature (476)..(476): n equals a,t,g, or c
actctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctcttcatcacctctcaacctttgcttcnacaggtcttcactcacnatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttccaaaaaaaaaaaaaaaaaaaaaaaaaaaaaaaaaaaaaaaaaaaaaa

SEQ ID NO: 4859 - DNA, 976 bp, Homo sapiens
  misc_feature (689)..(689): n equals a,t,g, or c
  misc_feature (837)..(837): n equals a,t,g, or c
  misc_feature (874)..(874): n equals a,t,g, or c
  misc_feature (962)..(962): n equals a,t,g, or c
tttttttttttttttttttttaagcaaataatgtttatttttatattgatgatacacttaatatatatgtggattcaaggtacaaaattcatgtacaagagttcacacctgatgaatgtagacacattcctagagaacatttatcaatgtgaaaatttctttaatacactgacaacaaaaatcaaatattctctaatctcgttattcaataaacatcaaaacaacgtttcagttttcatcctctagtactgaagtgccctcaaggtggtaggcactgtatagcaggagaaaacattggaaagcctactgaatccgctctgcagaatcacagtgtttactctgaaattcatttagtgaagtagtggaaggctatcttttatgacaaatcacatctcatacaagagtcaaaagtgatgaactcaagaaaataaaatgtttcaagaacttctcamtttctaaaatctatggagtattaaccataacagacaaagaagaaaaaggctgctggaaaggaagaaaaaaacatcctgtttaagagaacgtatggcttaagcaatttagaacacaactgacaagacttttacaataccacaaatgttcaagtcaaatgatagtgacagtataattttccccttagtcattggtagtaaatagccccttcaaaatttattctactgktaacacatatnaaaactatgaatccaaacagttttgctaacggggctgagttgatggatttttttctaaagtattaactcacaatatccaaatattaatacaaatgaacgacaagattgtttcaaagattacagtgatttgtgaatagctaaataggcnaccaaatagcttcattatttgcacgacagattagcancacttggataagaattgttacatgaaaaatattgtgcttcagtctcttgaggagagctaagtataactctatgatccctatagtgttnagattctataacat

SEQ ID NO: 4860 - DNA, 3045 bp, Homo sapiens
  misc_feature (2)..(2): n equals a,t,g, or c
  misc_feature (23)..(23): n equals a,t,g, or c
  misc_feature (31)..(31): n equals a,t,g, or c
  misc_feature (39)..(39): n equals a,t,g, or c
  misc_feature (84)..(84): n equals a,t,g, or c
  misc_feature (115)..(115): n equals a,t,g, or c
  misc_feature (274)..(274): n equals a,t,g, or c
tntttattaaacactctgcaaangttcccgnaaaatgcnagtgacagtataattttccccttagtcattggtagtttatagccntttcaaaatttattctactgtgtaacacatntaaaaactatgaatccaaacagttttgctaacggggctgagttgatggatttttttctaaagtattaactcacaatatccaaatattaatacaaatgaacgacaagattgtttcaaagattacagtgatttgtgaatagctaaataggcamccaaatancttcattatttgcacgacmsattagcagcacttggataagaattgttacatgaaaaatattgtgcttcagtctcttgaggagagctaatataactctataatccctatagtgttaaaattctataacatttcagttacagacaagcacaattgttaaaaagtatttcacaccactagaaaatcgagtaattatatcctccaaatgaattacttctatgatttaaacaagtgcatttctgcctaataatcagaatgtagacaataagttcagcattattttcaagggaaaaagatcaaacataacttattttaactcctatttgattatcttaacctttagtgatgattagaacttaaaaaagggaaactcaaccttccaatggaaactgctcagaggaaataataaagtgtcctgaaattacaataattcttagcacaaagtaaaaagtgatttataactgcttcatctgattcaatgattaatgaaatcactatttatactggtgctacacaacgaagataacctatatggataagttattttacttgtaaactctactatgaaaatgttaggactttgtatttgcctttcctawtatctaagatgkttctacctcaactggaagaatcatccaaaatctaaaggtttctctgattgttgaacagcaaggtttattaaaaataagcaaaaaagttggagaactagccatatggtctatgtggcaaaaggaatgcattcagataactataaaaagccacataaatcaagttctagattattgtactgaaccattagaaggtctttttaatgatacagtaacaagttaacaaaaaccattcttcaggaaatagtaataaaaattccttttttttttttttttgagaatgagtcttgctctgtcacccagactggagtgcaatggcacgatctcggctcactgcaacctccgcctcccaggttcaagcagttctcctgcctcagggcagcagagttgcagtgagccgagctcgtgccgaattcggcacgagatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaaygagtagagcatgaaggtagaacagtctatatactcttgtgacacatacaatccctaccttgtgctgccaagtaactcatttttgtgcaattctcagtataagccctttgtcgtttctrtgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaaaaaaaaaaaaaaaaactcgag

SEQ ID NO: 4861 - DNA, 562 bp, Homo sapiens
gaattcccgggtygacccacgcgtccgcccacgcgtccggtctcgaamtcctgacctcaggtgatccgcccacctcggcctcccaaagtgttgggattacaggcatgagacaccgcgcccggcgtttttttttttttttttttctttcaggaatttgggctgggcatggtggctcatgcctgtgatcccagagctttgggaagccgaggcaggaggattgcttgagcccaccagttcaagaccagcctgggcmacatagtgagacactgtatctacaaaaaattaaaaaattagccaggcggctggacaaggtggctcacgcctgtaattctagcactttgggaggccaaggtgggcagatcacctgagatcgaragttcaaraccagcctgamcaacatgraraaaccctgtctctactaaaaatacaaaattarctgggcgtggtggcgcatgcctgtaatcccagctacttgggaggctgaggcaggagaatcacttgaacccgggatgcagaagttgcggtgagccaagatcatgccgttgcactccagcttgggtaa

SEQ ID NO: 4862 - DNA, 1130 bp, Homo sapiens
  misc_feature (1002)..(1002): n equals a,t,g, or c
  misc_feature (1015)..(1015): n equals a,t,g, or c
  misc_feature (1069)..(1069): n equals a,t,g, or c
  misc_feature (1109)..(1109): n equals a,t,g, or c
ggtcgacctgctggtgagccgcttgcgccaacgcttgctggatgacgcccgcgaaccggcctatatcaagaccgtgcgcacgagggttatgtgttttcactgccggtgcaaatcctcggggccgagcaatgaggccatggcggtttggctggccgcgcacactggcgtcccaactgtcgctgatttttctgatcagcctggtgtgtgcccatgggttgtcattcagtgcgcagttctacgagcgctatatcagtgcgcgcacggtgatgctcggcaacctggaaaacgacgtgtccacctcggtggccatcctcgaccgcctgcccgccaacgaacgcgccattggctggcgcgttcttcgaccggcagaattaccggtattgctcaacgccggcgaagccggtgaaccgatgactagcaacgatgtgccaatggccgccamcttcgattgcggamgcamtgggcgagcattamgccctgacctttcgcgatattccaggcatccagaaacayttccaggtgcamctgaccctggccgatggcaacccgatcaccctcgacgtacgccccgccgccctgcccgtagcctattggttgccggtggtgctggtgctgcaactggcgctgctgctcggctgcacctgggtcgcggtgcgcctggccgtgcgcccgctgacacgcctggcccgtgcggtcgaaaccctcgacccgaacgctcaccccacacccctggacgaaaccggcccgagtgaagtcgcgcatgccgccgcggcgttcaatgccatgcaacagcgcattgccgaatacctcaaggaacgcatgcagatcctcgcggcgatttcccatgacctgcaaacgccgatcacccgcatgaaactgcgcgccgagtttatggacgacagcgccgaccgcgaaaaactgwggagcgacctgagcgaaatggagcacctggtacgtgaaggcgtggcgtatgcgccgcagcgttcacggcgccaccgaggncaagcaccggcanttgaacctgggaacgcctttcttcgaacaggcctggtgggtttggactattcanggacattggcaaaaaagcaaggtcaagccttgcgccgggnaaaaaagcgcggcttgaatcc

SEQ ID NO: 4863 - DNA, 527 bp, Homo sapiens
  misc_feature (5)..(5): n equals a,t,g, or c
  misc_feature (11)..(11): n equals a,t,g, or c
  misc_feature (17)..(17): n equals a,t,g, or c
  misc_feature (517)..(517): n equals a,t,g, or c
  misc_feature (522)..(523): n equals a,t,g, or c
  misc_feature (527)..(527): n equals a,t,g, or c
tcagnggttgngaggangcctgyttcgccacagaacagtgcgmtaaagactcaaccgaatctcggcgcacaagccgccttcaacccgattgctcaaggtcagcgtgccgccgatcgccaccgccagttgctgggcaatcgccaaccccagcccggtgccgccggtgccgcgattgcgtgagctttctacccggtagaacggctgcagcacctgcgccaattcgtcttcggcaattccggggccttggtccaacaccttgatcgacaactgcccattggctgtcgagccgacttccagctcggcgttgccggcgaatttaagggcgttgtccaccaggttcaccaacacgcggcgcagcgcgtgggggcgggtgtcgaggatcagcgcgcttttgccgcgcaggctgacctgcttttgcatgtcctgatagtcaaacaccaggctgtcgaraaaggcgtccaggtcaatgcggtggctggcctcggtggcgccgkgaacgctgcgcgaatacgccacnagttnncctn

SEQ ID NO: 4864 - DNA, 171 bp, Homo sapiens
tgaattggggcggcttcgccacccaacgcagggcaagcctgcttgccacattgaatgcacagctttaataaaatttacgcatgataattctgctttttataattaggttagaaccaacaggcattttacagaccccgccacggcccttacttttgacccgagtgaccgacc

SEQ ID NO: 4865 - DNA, 610 bp, Homo sapiens
  misc_feature (602)..(602): n equals a,t,g, or c
ttttgacccgagtgacccgaccccaacgcccggagaggtkttaacgcgmaatcgacaaggacagaccatgagcatcgaacttatcggttatatcggcggccatcacgcttccgagattcacccgcgcagcggccctaccctgcagccggatacgtcgaaaccgtggcccgcgcccacgaagcggccggcttcgaccgcgcgttggtggcgtttcattccaacagcccggacagcacgctgatcgccgcgcatgccgccagcgtgacccaaaagctgcagttcctgatcgcccatcgcccaggttktgcccagccgaccctggccgctcgccagttcgcgaccctggacgtgttcaacggcgggcgcacggccgtgcatatcatcaccggcggcgatgaccgtgaactgcgtgccgatggcagccatatcggcaaggacgaacgttacgcacgcaccgacgaatacctcagcgtggtgcgccaggaatggacccacgagcagcctttmgattttaaaggcacctactaccaggtcgaaggcgcgcactcgacggtgaagtcgccgcagcaaccgcatatcccgctgtacttcggcggctcttnccgcggcc

SEQ ID NO: 4866 - DNA, 1516 bp, Homo sapiens
gggtcgacccacgcgtccgcgagtagctgggattacaggtgagcaaccacaacgcatggctaattttttgtattttagtggagatggggtttcaccatgttggccaggatggtctcgatctcctgacctcatgttccgcaggcctcggcctcccaaagggctgggattacaggtgtgagtcactgcaccccgcccaggcctttgtctttctttaacgtgctgcttaaatccacgatgtgaattgtatgttagtgtgaatgtttccgagagtagaattttttttccttttgagaacctcagtggcattgcctgctcttgccctctctgggaaggacagcagaggggacactgctgtccctggctgtgacaatgtgcagtgatcacagggaggctttcaccctccaccctaacagtcagtcccagctgagccaacccaggatctggttttctgtatatcagatgcacgatgcacacaactgttttattaagcatgaaacaaaaccaagaagtataacagtgctttacagttcttctcttaattctgggcctcgtatgatcttatcatgtattaacctcagaaacactacttttgcacatgtcagttaactgtacacaaatagtgccaattcctgccctgttgatgggagctggctttgctattagaggacttactgctatcgggggtttggcatgaaggtggtgcctgattagtttgatgatgggaaaaaacacagcaccttaagaagtacagaatcatagcaacgcagggccagtgggaaccacagggtcaccttcccagctcctgcattttacactgcagtgaagaagccaagtgatctgattgaggtcacttagctcatgagagccagagccagaggcctagatactcttccctcagcacagcaaaaaggtgactctgtaagatgagaggaccctagagattcatatcaagcagcataggatctgggaaatgttgtcttggcccctagagtgtagtgaaaactgggttttctggagaacaagagaaagcttcagttaagtcattctggtaaccagggctggcatcccgtgaagccgcgagcatagcaaacttgtgggaattttgtgttgaagaactcgaaggattcttccctgccgtactgcaggctgcaggattgggatctcctttttctcatttcccacggtgaatacccccagcccatgtgccagtgggttgcataataaatatttggtgatgtatatatgaaagaaaggtgaagccgggcgcggtggctcacgcctgtaatcctagcactttggggggccgaggcgggccgatcacaaggtcaggagatatctcaagaccatcctggctaacacggtgaaagcctgtctctactaaaaatgcaaaaaattggccgggcgtggtggtgggcgcctgtggtcccagctactcgggaggctgaggccgagattgtgccactgcactccagcctgggcgacagagcgagactccgtctcaaaaaaaaaaaaaaaa

SEQ ID NO: 4867 - DNA, 1720 bp, Homo sapiens
aaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctacccaagagtcacacttgcaggtgccagagaaatcctcccagaaggagctggaggccatgggcttgggcaccccttcagaagcgattgaaattagagaggctgctcacccaacagacgtctccatctccaaaacagccttgtwctcccgcatcaggaccactgaggtggagaaacctgcaggccttctgttccagcagcccgaacttggactctgccctccagatcgccagagcagagatcataaccaaggasagagaggtctcagaatggaaagataaatatgaagaaagcaggcgggaagtgatggaaatgaggaaaatcagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggagcgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcacttttttgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttccccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaaaaaaaaaaaaaaaaaaaaaaaaaaaaaaaaaaaaaaaaaaaattc

SEQ ID NO: 4868 - DNA, 1333 bp, Homo sapiens
gaattcggcacgagcccaggagtgcagtggtatgatcatagttcaccgtagcctcaaactcgtgggctcaagtgatcctccagccttaacctcccgaatagcctggcttataggtgcacgccacacacctgactgctcagtatgtaaatttttactatgcctaaggttgaccaccttttaatatgtttaggagccatttgtatttccttttgtttcccatattgttttgttcctatccatttttctactatatcgttgatatgttgtttatttgttagggatatgaaccctttgacagtaatgagttgcaaatattttctttccaatttgtcatctgtcttttgcttatgatggctttgtcatgagttttaaaaaatttttatgtagtctgaataccagtttttttagtggtttctggattttgagtcataattagaatgtwtttctcaatccagagcaatagagtaattcacctaaattctacatctaaattttgaacctctgaagcatattctggcataagatataagttatggatctaacctaattttttccgcaggtgattaacccagttgttccaatattatttattgaactgtttgttttttcctgacgagtttgagargctacattgatcttatcttagaatccgtcatatgtatttagctgtgtatctgcttctgtttctctgtatctgtttctatttcattgctctatttagtcatgcactartaccacattgttttaattacccaggctttagttttaatctagtgcattggtcctccctcattcctcccctgcccamcttttttttttttaacagtttttctaactgttccttatttttcccatatgrgctttaaaaaattcttaacatatagagcatactaaaactgtccaactcaagttctctcccaagggttgcacttttaaccacttattttgtcactgttcttttgatactttmcctgataaagatacactttttactacttttaaattattacagtgttctatttggcagtgcccaaacaggtgatggcagatagaggcaggatgcaatgcctgtgtggaaagaatgtcatctcagtgcttctattttaagatagtctctaggaatgatttaaggactgttctcatgtaaaatccctatttctttttttattccattacgaattatttgcccaaaagttggatatctgtcaaagattcataagacaagagggagagacccttaaataagtactaaacttgtaaaatcaatatgtggataaaagtgcaagtacaagaagttactttggaaaaaaaaaaaaaaaaaaaaaaaactcga

SEQ ID NO: 4869 - DNA, 489 bp, Homo sapiens
ggcacgagaggctttgaagcatttttgtctgtgctccctgatcttcaggtcaccaccatgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacaaaaaaaaaaaaaaa

SEQ ID NO: 4870 - DNA, 2024 bp, Homo sapiens
  misc_feature (540)..(540): n equals a,t,g, or c
ggcacgaggttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgctttttttttttttttaaaggaaagctgctctttgctcagtatagtgttttgaaagtgaacatagtaacaaatactttaaaaataaaggatacacaatttatatttgaaaataaaaactttctgctggtgggattatttatagtcctttatttttaaaaaaaatgtttccctttttatattgctcttgaaagtttaatgagcagaatacaatactggttataataaaaatatggtaaccacacagtactcagcctttcaatatgttttgggtcaaactncatttaggcactagcatttagaaaaataccaatcacagtgatgctttggttatttaatatgaaggaaatggaactaaaacatttatgtcatcaaatttatttcactcctttatatttgactggctggttgatacataatggttgatgaacatatatttgcttaaatcactaatagggatggttgtaaagtaaatagatcattggttcaaccatttaagtgtttttgccagattgtcaatgaaaccatcatactgaccttttcctccaaaattgccaaattgactgaactggttgggtgtttgttaaaatgaavtcaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgtttgcatttttcttttagatacagctgtgtgcattttatgattgggttgttttgcttttacctactaagtaaaaaa

SEQ ID NO: 4871 - DNA, 495 bp, Homo sapiens
ggtggaatgtagtgaaaacgagatgctgtctctwagggactaaggaagctatctttcctcttccgacatttgctgactggtcgatgctagatgatcttgagaccctgtgctgaggactggagaactacaggaaaggagcagtatctctgaattatcgtgtggaaggtcacttgtctagcccctgatgactgtgagcctcttcctcctgcttgccacctctcagtcacaagacggctgctgcgactcaggctcatgtcccaattcaaggcagcaagaaggccatggagcggcacctgccagcagatgcccctgcaggccatctctccaggctcaggaacctaaagaagaatctacccagatgtggtgctcacacctgtgatcccaccactttgggaggctgaggcaagaggatcacttgagcccaggagttggagaccaacgtaggcaatacagcaagactcccatctctacaaaaaaaaaaaaaaaaaactcgag

SEQ ID NO: 4872 - DNA, 475 bp, Homo sapiens
cggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtagtggctgccagtccctcgttgcaggacagggtcatcataaccataaataacccttcacgtgtcaaaaaaaaaaaaaaaaaaaaaaaaaaaaa

SEQ ID NO: 4873 - DNA, 481 bp, Homo sapiens
  misc_feature (416)..(416): n equals a,t,g, or c
tcgacccacgcgtccgccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgarcgtggaggaggagaangtccggtacttcgggaaargctacatggtggtgctccggcttgcgacgggctttttccaccccct

SEQ ID NO: 4874 - DNA, 1370 bp, Homo sapiens
catgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagttttggtgatgagaagaagtactggttgctacccattttttcaagtctaggtgatggctgctcctttccaacttgccttgttaaccaggatcctgaacaagcatctactcctgcagggctgaattccacagctaaaaatctcgaaaaccatcagtttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagtaaaaaaaaaaaaaaaaaaaaa

SEQ ID NO: 4875 - DNA, 1392 bp, Homo sapiens
cccccgggctgcaggaattccatgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaactttgccttgttaaccaggatcctgaacaagcatctactcctgcagggctgaattccacagctaaaaatctcgaaaaccatcaggttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagtaaaaaaaaaaaaaaaaaaaaa

SEQ ID NO: 4876 - DNA, 849 bp, Homo sapiens
  misc_feature (1)..(1): n equals a,t,g, or c
  misc_feature (26)..(26): n equals a,t,g, or c
  misc_feature (49)..(49): n equals a,t,g, or c
  misc_feature (775)..(775): n equals a,t,g, or c
  misc_feature (778)..(778): n equals a,t,g, or c
  misc_feature (835)..(835): n equals a,t,g, or c
nccgggacgggggaatggaaacgganaaccccccttactatagggaacnaaagctggagctccaccgcggtggcggccgctctagaactagtggatcccccgggctgcaggaattccgacgtgtgttaggaagctacaatggcagctccctagtggaggtgtttcggaaaaactccgaagattccacttgagaaaatcatcggccttcagacaacgtctatgccagataatgctaccaaatcacaaccttgcctttcctccctactgctgttctgatgtgggaggacccaaaggcagcagaagagccaaagaagagtagcagaaaggcatatccacagctcttcaaataagcaatgtgatgttagcaaaagtgcaggggctccttgagaactttccagggctaaccagctgctgaggagtggcctccaggaaagagagaagcactctgattcaggcagtgatttacacctaaaataccaactccgtcatatcttcagaacaattcttctagaccttgcatctaaatatgggatcagcatgtgcaaagatgaagaggcataaggactgaccagtgggtcacggcaatgagacatttactgctgacctccaagagaagacttccattgaatgagaggaagatctacactactaatgatcaaacttacctggagcagtatctgacacagatatgtgttgagtgaatggatgaataaatagatagaaggaagatcctccmactatgaagttcttcttttcttctgctgctggtgagtanatnagggtgccaagaaataagacagcaacaccaggaagaaaacaaawttggggcacttgnttgctggacctgag

SEQ ID NO: 4877 - DNA, 835 bp, Homo sapiens
  misc_feature (33)..(33): n equals a,t,g, or c
  misc_feature (81)..(81): n equals a,t,g, or c
tgggctttagttcaagtgagtcttcctcctacnttccgtggtaagtacaccaccaaagagatctgatgttggggagttccnacgtacttctaggtgatacaaaatagttatttccattcccggaaatcctcctgcaaggatttctgaaaccattctattgtataaaatctgtatgttcccaatttaaaaatatmcaaaacacccttccaagtcatttgaattaacactagtattaaggaagctaagtctgcataaccagccccctggaaagacagaatgccatctcctcaagtctaagtgctgtgtaatcattactctacaaaccaagtggagatattacctattctgcaaacagcaaaccaagcaaaattcctaggtgctcccaagggamcaaatcatgcagagaaactgctctctgcttctctcgaaagccctcgctgttcccaggggccctaaaactcattatcccctgcgggtgaacagcagactccagtagttgtatacttctagaaagtggaagcagtacatctaaatgttttcaaagtttgctcatgacaaggaagggaaggatggggactcaagggctgggtaagtaaagagtgttatggaccaagagggtcagcaaagagggggcggtagaaaatgtaaggagagagaaaattgatagaaacaggtccaggagcaagtgaaagatttgctccagtggaattaacatgaatatacatggggatgggggggcagcacttgaattttagaaacaaaaaaaaaaaaggaattcgatatcaagcttatcgataccgtcgacctcgagggggggcccggtacccaattcgcc

SEQ ID NO: 4878 - DNA, 1650 bp, Homo sapiens
ccctttgcacatcttccatatactttaaatcatctctacattacttataataatgaatgtagtgtaaatgctatgaaaatagttactacactgtattgtttatttgtatttttattgaattgttttggggtggggggcagctgtatctttcttagtaatagaacccctggttttagctgggcacatgactgccctcaataaagattaaagtaccccagccttccttgagattgtggccatgtgactgaactttagacagtgagatataagcagatatcttctgtggcagtgttaggaaactattaaagacagtaagaacattgccctttgccttctttttcctttcttcatttttctgtctggaatgcaaatgtgatagctaacaccctagcagccattttagattatgaagatgagagtcactccccaggaagggtggacctgaaagctggattctagatgtggaatgacaataccagccctggactacctacctgtaggctgtgtgtgtgtgtgtgtgtgtgattgacagagagagagagatagagagagataccacaagtaacacaaagcatcatacctgggactgggaaggttaatgtttaaacattttaaatgtggcattggtttgttgaagacagtcaagcagtaggtgctgcaggctttgttgaggctagaaagctgttggtctttattaggtgatggcaaaacaatggatcacattttcatgtgctgtgtcttgggaggcaaatgatgagaatgtaggattggggaaaatggtaaggaaaatccaaaatgttcatgttttctaaccccttcttgccaatcttaaaagaaggacaaacaggctagattaagcaagtctacagttacaattggaaggaaacacagccgtactaaggaagtactctgtctgtggcctgcagtctagtttgactaggtcctgtatttgagctttgaaaaagtaaagaatacaagtgctcgtatacccctgaagtacttaccagcagtgactgcaaggaggtaatcttatgggatgaaactataactctgtattaaccatcatatatagcatatatgtgtatatgtatgtgtgtgtgtgtatatgtgtatataaatatatgtgtgtgtatatacacacatgtacacacaccctacaacccagtgatttcaaaaaattaaacatttgtttagctcatgaatctgtgggttgggtgaacatttctattggtcttggctgggctcacctgtacccagtcagctgcagggtctagctcttcttatcttggctgggatctcacacatgtctaggatcagctgctttactagtctaggattgtcttggctgagacaggtggactactcagttctcctccactgccttatccttcagctggccagcccagaaatgttgccatgtttacagcataagagcaagcaagaaagaataatatgcaaccacttttccaagcctaaggtgaaagggcgggcagaacctgtggtgttaggaggcaactcataccagcccatgggtctactgtttaattttcagaaatttggcaagctgattgttaacacagctgttgtttaatttatgtacttgtaattaaataatttacattaaaacaaagataataggtactcaaaaaa

SEQ ID NO: 4879 - DNA, 2307 bp, Homo sapiens
  misc_feature (2000)..(2000): n equals a,t,g, or c
  misc_feature (2275)..(2275): n equals a,t,g, or c
  misc_feature (2285)..(2285): n equals a,t,g, or c
  misc_feature (2290)..(2290): n equals a,t,g, or c
  misc_feature (2292)..(2292): n equals a,t,g, or c
gctccccgcggcggcggccgctctagaactagtggatcccccgggctgcaggaattcccctttgcacatcttccatatactttaaatcatctctacattacttataataatgaatgtagtgtaaatgctatgaaaatagttactacactgtattgtttatttgtatttttattgaattgttttggggtggggggcagctgtatctttcttagtaatagaacccctggttttagctgggcacatgactgccctcaataaagattaaagtaccccagccttccttgagattgtggccatgtgactgaactttagacagtgagatataagcagatatcttctgtggcagtgttaggaaactattaaagacagtaagaacattgccctttgccttctttttcctttcttcatttttctgtctggaatgcaaatgtgatagctaacaccctarcagccattttagattatgaagatgagagtcactccccaggaagggtggacctgaaagctggattctagatgtggaatgacaataccagccctggactacctacctgtaggctgtgtgtgtgtgtgtgtgtgtgattgacagagagagagagatagagagagataccacaagtaacacaaagcatcatacctgggactgggaaggttaatgtttaaacattttaaatgtggcattggtttgttgaagacagtcaagcagtaggtgctgcaggctttgttgaggctagaaagctgttggtctttattaggtgatggcaaaacaatggatcacattttcatgtgctgtgtcttgggaggcaaatgatgagaatgtaggattggggaaaatggtaaggaaaatccaaaatgttcatgttttctaaccccttcttgccaatcttaaaagaaggacaaacaggctagattaagcaagtctacagttacaattggaaggaaacacagccgtactaaggaagtactctgtctgtggcctgcagtctagtttgactaggtcctgtatttgagctttgaaaragtaaagaatacaagtgctcgtatacccctgaagtasttaccagcagtgactgcaaggaggtaatcttatgggatgaaactataactctgtattaaccatcatatatagcatatatgtgtatatgtatgtgtgtgtgtgtatatgtgtatataaatatatgygtgwgtatatacacacatgtacacacaccctacaacccagtgatttcaaaaaattaaacatttgtttagctcatgaatctgtgggttgggtgaacatttctattggtcttggctgggctcacctgtacccagtcagctgcagggtctagctcttcttatcttggctgggatctcacacatgtctaggatcagctgctttactagtctaggattgtcttggctgagacaggtggactactcagttctcctccactgccttatccttcagctggccagcccagaaatgttgccatgtttacagcataagagcaagcaagaaagaataatatgcaaccacttttccaagcctaaggtgaaagggcgggcagaacctgtggtgttaggaggcaactcataccagcccatgggtctactgtttaattttcagaaatttggcaagctgattgttaacacagctgttgtttaatttatgtacttgtaattaaataatttacattaaaacaaagataataggtactcaaaaaaggaattcgatatcaagcttatcgataccgtcgacctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgntaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagctttttggggtcgaggtgccgtaaagcactaaatcggaaccctaaagggagcccccgatttagagcttgacggcnaaagccggcnaacgngncgagaaaggaaggca

SEQ ID NO: 4880 - DNA, 2497 bp, Homo sapiens
gaattcccggcgctgaggtcggaacgtytgcgtgtgtgcgggctggttttgtggcggctgctgctagagctggagcatttgccggtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccaraaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactraagaccagaagatcagagaaggaaactttaatgctgtctagcctcctgctattaatgcaatcaaagaatacttttgcatatgtcttgataattaaatagtatttgttaactgkgatatgcatacacttatataagcagaattatgagttaaagtaatacttrgcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaaaaaaaaaaaaaaggaattcgatatcaagcttatcgataccgtcgacctcga

SEQ ID NO: 4881 - DNA, 602 bp, Homo sapiens
  misc_feature (564)..(564): n equals a,t,g, or c
  misc_feature (581)..(581): n equals a,t,g, or c
  misc_feature (591)..(591): n equals a,t,g, or c
  misc_feature (595)..(595): n equals a,t,g, or c
  misc_feature (600)..(600): n equals a,t,g, or c
aaccctcagaaatcaacagtagaaaacttctctaaaacagctttggcctttttgcatatgaatgacttttactgcgtaaatcagttattttgcttaccatcctagtcctctgctttccaccccaaatccttgtttatgtgtgtgtggttttgtttgtttgcttgtttgtttgcttgtttgttttttgagacggagtctcactctgttgcccaggctggagtgcagtggctcgatctcagctctctgcagcaacctccacctcccgggttcaagtgcttctcctgcctctgcctcctgagtagctgggactacaggcgcgcatgccaccatacccggataatttttgtatttttagtagaaatggggtttcaccatgttgaccaggctgatcttgaactcctgacctcaagtgatccacccgccttagcctcccgaagtgctgggattacaggtgtgagccaccacaccccgcctgcgtgyttggtttttaaatttctcttcttagggtcatgagatttctcattaatttcacttaaaagctcctggagagaaaaagcccctatnattggcactattacagnaaaaaaaagngganaagantt

SEQ ID NO: 4882 - DNA, 689 bp, Homo sapiens
  misc_feature (2)..(2): n equals a,t,g, or c
  misc_feature (20)..(20): n equals a,t,g, or c
  misc_feature (174)..(174): n equals a,t,g, or c
  misc_feature (176)..(176): n equals a,t,g, or c
  misc_feature (299)..(299): n equals a,t,g, or c
  misc_feature (519)..(519): n equals a,t,g, or c
cncatcatcatgagaatgtngcaacttttattttgcagtaactgtttaaaattgtggccaacagtgctcagtaaaaggggaccttccccctgtaggtgtttggggaggagtgacgtcctgtcctccattttgttagtaacccacttatggatggggcattatcacctagaaagnanagagataccatggtatgcagttacagggagccagagcaagagcaagacaaagaaattcccttacgtcttcaatgcagagccggcatttagacctctaccccaggcaggacccacaaatctttngcagccatgagcacctgttttgctcctgccttcttcctgttggcaattttgggttttggggttttttttttttagacagagtctcactccatcaccaggctggaagtacagtggtgcagtctcggcccactgcagcctccgccttccgggttcaaatgatcctcttgcttcagcctcccaattagctgggactacaggtgcgcaccaccacggccagctnatttttgtatttttagtagagatggggtttcaccatattgcccaggctggtctcaaactcmtgacctcaagtgatctgctcacctcagcctttcaaagtgctgggwttatatatattttaaataaatgaatagaattcgatatcaagcttatcgataccgtcgacctcga

SEQ ID NO: 4883 - DNA, 845 bp, Homo sapiens
  misc_feature (718)..(718): n equals a,t,g, or c
  misc_feature (737)..(737): n equals a,t,g, or c
  misc_feature (760)..(760): n equals a,t,g, or c
  misc_feature (764)..(764): n equals a,t,g, or c
  misc_feature (785)..(785): n equals a,t,g, or c
  misc_feature (807)..(807): n equals a,t,g, or c
  misc_feature (825)..(825): n equals a,t,g, or c
actcgaaattaacctcactaaagggaacaaaagctggagctccaccgcggtggcggccgctctagaactagtggatcccccgggctgcaggaattccttgccagggagtttgcctcatgattacagttgtttcttccagaggatttcaccaggaagagagtagcggtgtttcccatgattttaaggctgtgaatgtttttggctttgcgagaactgaggaatgcacctgccattaagcacaaagggcatcttgccaagaattttgttattgttcattaaaaccttatttgcatttctgctctcagatcagtgcaaagggttagcacatctgtggttgaggaggagagagtgtggaccaggcggccttacctgtgctgcagaggagctgaagtcttacacttccatatttgcccctaagctgggggttgttgggggcakggaaatgaagtaggttgttagctcactgggagacaatttgggggatgatttattttttaatgtttttcagctgccttgagtcacaaacgtgatttaaaaaacaaccagatttgtaaaaaggtagtttctctctcacacatgtacacaattaccaccgcaacaaaaaattccatagcaatgcacatcccacacttacctggccatatattttgtggaggatagaatttgcttttcttcttcctcctggggtaagggtgggaggtggagaatgcttatgggnccattttgcagttagcacnctttgggctgaaatgccttagtngggnaccaatttaaatcaccaccanttaattccaacccatccaattngccttcctccaaccaatnccaagaagggctttcctggg

SEQ ID NO: 4884 - DNA, 466 bp, Homo sapiens
  misc_feature (279)..(279): n equals a,t,g, or c
  misc_feature (463)..(463): n equals a,t,g, or c
gttatgggcccatttgcagttaccactctttgggctgaatgccttagtgggaacaattaatcacacatttattcaaccatcatttgcttctcaccatccagaggcttctggccaagggctcccaactctgyttttgtgggtgcttgtgagtgtaattaacacctgaaactgccttcaggtgagtgaggtgggtggttwctgcccttggggtatgctgtctggccagaatggagctgtaatttctgatcctttgcagtgtctgtaaaaaccgaatcccancgcttcgggaggctggggcaggcggatcatgaagtcaagagattgagaccagcctggccaacatggtgaagccccatctctactaaaaatagaaaaattagccgggsgtggkggtgcgtgcctgtcatcccagctactcgggargctgaggcaggagaatcacttgaacccaggaggtggaggntgg

SEQ ID NO: 4885 - DNA, 311 bp, Homo sapiens
  misc_feature (14)..(14): n equals a,t,g, or c
  misc_feature (105)..(105): n equals a,t,g, or c
  misc_feature (107)..(107): n equals a,t,g, or c
tctggttttgtgtncgcatggtccattttgactccgggatgtatctctcctgctggggaaaaatgcaggggaggaaagcagagtcttggcactaactacttcttntntgtcttattggcaactgattcatgaactytaaaaaaagagttgatagcaacatagccagctagctgtagcagcccagatggtcccctatataatagagacatttgtatyttggattaaaaaaaatttaactgtgttytgtgracgtttttaaaaaaaaagaaaaaaggrattcgatatcaagcttatcgataccgtcgacctcg

SEQ ID NO: 4886 - DNA, 1102 bp, Homo sapiens
  misc_feature (462)..(462): n equals a,t,g, or c
  misc_feature (469)..(469): n equals a,t,g, or c
ttttttttttaccatttaaaataaaatgaaagtgaccttctgtttataaaaatctttgtctgcatctctgcttatttccttagaagagattccaagaagcggtgagtgatttcacggcagcagagggttgggacatattacgggcgcggatccctcttggagtgagatgactctccggagagatttagtcgtcaccctcgcgtgtgaggctgcgtcacaccccagggatgtgtctatcaagatggaagatcttttacacgctcttgattttgtttgsctytttttctattactagtgagaakgaaactttttatatgattattatccatcataatccaacacaaattactgcttcatgttcttttactttcctgtgaaggttttagtgccttttaaaaattgctatatattaagcttgttaatacttccatgctgtatttgtggscatcartttccccgggnacaggcntgcacattttgccttcacacgctgggtggtttttcattttcamttctatttctcgttcttctatcgttttatgttcagacgggtttctccgtgtagaaagcagtttatgaagatttactttcgacagtcttctctctactttctacagtgaattctctgatgtgtctgggagtttgggggtctgggtaagartcctcctctcaccctattctctattacgatccacagcctcatgctttatgarattggtggccgggarcgggggagatttgcggatcccccaagccagactttatccccctatccctgcctctggatcccacgtacaggcctgggaactccctgtgggtaggggccaatggtctcgcactctcacctgtaccccagggctggcacaggatggtcaaggagagaggctgcccaagcgcatccytctggtgtccccctgacacgcctccaaagtgagcaggtaggtttcaacagccccacgttgcaggtgggagatgaagctcagggtggagaccagtatctcacagttctctttgcatggccgggtacttgttagtcaactgatcaagtgaaaattctagccccagaggcaggagaatccggaacaaaattaaaccagccagg

SEQ ID NO: 4887 - DNA, 822 bp, Homo sapiens
  misc_feature (3)..(3): n equals a,t,g, or c
  misc_feature (9)..(9): n equals a,t,g, or c
  misc_feature (16)..(16): n equals a,t,g, or c
  misc_feature (53)..(53): n equals a,t,g, or c
  misc_feature (72)..(72): n equals a,t,g, or c
  misc_feature (174)..(174): n equals a,t,g, or c
ttncttccnagggttnctgcggcatggaaatagaagttctcaaaagagcggcnatctgggttagggcttccntgctgctgctgctgctgctgctgtggttgctgctgctgctgctgcttctgtggagggaaggcagccaccgggtttgggggcggtgggccctgccggaagacntgccggttcacytggtgsccgaatgccagctggaagggttgcaggggcagtgactggtttgggggtttcttggctgcgtggaaagaattcaggggtgcctggggccgccctacctccagctgcaccttctgtggcatcattggtcgcacatagcggtccagctgtgggccccccgctttctccckcttcagtgcctcagggtggttatagtaagtcgggactcccactccaggatgcgggctccccttggtkgcactgtagagggacagactgtggcagttccatgttgaatggggtggaggctggcytggctgctgctgccagctgctgtcactgacacccccacctcctccacgctccgggccccgccctggagccatcacagagttgggccactttactgaggccacctgctgggacagcatggctgctgaggtccgctcaggcccatataccacagagttcagcagggccaggctgctaggagggggcagttccacaggctgagaggtggagactgcccctcctggaccctcgtgcccgaggtactgctcctccttcactctgatggactgctgggggggctgcaggggagggggctgctccttgggaattcgatatcaagcttatcgataccgtcgacctcga

SEQ ID NO: 4888 - DNA, 1754 bp, Homo sapiens
tttttttttttttgtttaaatgatacaacttaattttattaggacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcattggaattcgatatcaagcttatcgataccgtcgacctcgag

SEQ ID NO: 4889 - DNA, 372 bp, Homo sapiens
  misc_feature (309)..(309): n equals a,t,g, or c
ggcacgagaagactggagcctttgcggcggcgctgcccctcccctggtccccgcgagctcggagggcccggctggtgctgcgggggccccgggaggtacggacctgggaggcgaggctcgtccggcgctaggatcggcctccgcctccgggccgctttaggttgaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacattacgtgggctncattgagacagaccggggggtgcgagagcaggtgcgttttatgacaaccgggggctccgagat

SEQ ID NO: 4890 - DNA, 1590 bp, Homo sapiens
cccacgcgtccgagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacaggctggtcccagacctcagagttcaggtcttcatgctggaatcctgggaagcactgaacgtggagtcaggagatgtgggtttgagtcctgagatttgctgtgacttcatctggaagatggggttttgataccttttttaaagatctgaccctggctgtgcccatctgtaactctctggctatcatcttcacactgattgttgggaaggcccttggagaagatattggtggaaaacgtaagttagactactgcgagtgcgggacgcagctctgtggatctcgacatacctgtgttagttccttcccagaacccatctccccagagtgggtgaggacacggccttttcccatcctgccctttcctctgcagctgttttgcttccttgtggccatcagagttcccttcccctggacagtctggagaaagacagagctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcgggatgggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagaaaaaaaaaaaaaaaaaaaaaaaaaaaaaaaaaaaaaa

SEQ ID NO: 4891 - DNA, 794 bp, Homo sapiens
  misc_feature (345)..(345): n equals a,t,g, or c
tcgacccacgcgtccgagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactggggatactgcctgacctcattcgangctgcccattgaatattcggcaaggaagcctctctgctaaaccccctgagtctgagggatttggagacaggctgttccttaagcagagaatgagcttactctctcagatgacttcgtctcccaccgactgcctgtttaaggctgatgctctattagaataaaagaggatcccctagtccatagcaagtataaaaataataataaataaaaaaataacaagatgaagctgggcatggtggtgtgcacttgtagtcccagctatatgggaggctgaggtgggaggatcacttgagcccgagaggttgaggctgcagtgagctctgattgtgccactctactccagcctgggcaacatagcaagaccttgtttctaaaaaaataaataaataaattctgttatttgtcaccctgtagggattcactgaaaaaaaaaaaaaaaaagggcggcc

SEQ ID NO: 4892 - DNA, 707 bp, Homo sapiens
  misc_feature (481)..(481): n equals a,t,g, or c
  misc_feature (539)..(539): n equals a,t,g, or c
  misc_feature (615)..(615): n equals a,t,g, or c
  misc_feature (670)..(670): n equals a,t,g, or c
  misc_feature (679)..(679): n equals a,t,g, or c
  misc_feature (692)..(693): n equals a,t,g, or c
gcccacgcgtccgaggtcttcttcatggtggtggcagcggtgtacattctgtacctcttgttcttgatagtgcgggcgtgttccgagctacgtcacatgccttatgtggatctcaggttgaaatttttgactgcattgactttcgtagtacttgtcattagcatcgccatcctttatttgagatttggggcgcaagtactacaagacaattttgtagcagagctgtcaactcactaccagaattcagccgagttcttatctttctatggcctgttgaacttctatctctacaccttggcctttgtatattctccatcgaagaatgccctctatgagtcccagctgaaagacaatcctgccttctccatgctgaatgactcggatgatgatgtgatttatgggagtgactatkaggaaatgccgctgcagaacggccaggccatccgggccaagtacaaggaggagtcagatagtgactganccccggccagcccagcgaggcgacagatgctggatgctttcccgggaccgctgtgacnttcctgtatatcaratttcttacagccgaaattctggtaattgttacaaattttttaaggaaaccaaactgggggnaaattaaaggtaaccaattatgcatgggggttcaaaaaggcttgtacaagtttanagccaaacntttttcggaattnnaaaacgggtttagg

SEQ ID NO: 4893 - DNA, 912 bp, Homo sapiens
  misc_feature (4)..(4): n equals a,t,g, or c
  misc_feature (24)..(24): n equals a,t,g, or c
  misc_feature (819)..(819): n equals a,t,g, or c
  misc_feature (883)..(883): n equals a,t,g, or c
  misc_feature (909)..(909): n equals a,t,g, or c
gganagactcactcggatgttgmnggatttatgssagtgactatgaggaaatgccgctgcagaacggccaggccatccgggccaagtacaaggaggagtcagatagtgactgagccccggccagcccagcgaggcgacaagatgcctggatgctttccccggtgaccgtctgttgaccttcccctgttatattcagatttttcttacaagcagagatttcctgttcatttgtttacatatttttttaaaggaaaaccaaaactgagggtaaatttaaatgtttagccaaatttattgtcatggtggctacgagaagaggcattgataacaagtttcaacagccaaatccttttttacagagatttcagatgagcgtgttttcagtgatgaggaaatttcacgtttttagtacagtgaattatgtacttttttttcctgtaatcattcactgattccaagttcacgggcagcctgtgactaggtcctcagcgtgacagcatcaccctctttcttcccttttccatggtactgttttgtgaccctttaaactcaaagggaagccttatctgtggctgcttcagggcagtccttcctcgttgagtggccagtgccctgggtaaccaggtggctgaagtgattggtcagttatgtggactgcgttttgtgcagygtgtgagttatgactcatcgggaatgggagatgctggggttccaacccttcacgtcaccaaaggggaagtaatagtgtggagttctgaggagggttkgataagktgaataasgaaaggctaagataatttacagggtaccaactcatgngggggaagggcttactggccatggggctttttcaaggggcctgggggggaccacacaatgaatnaaatggaattggcctggggggaaggnaat

SEQ ID NO: 4894 - DNA, 2194 bp, Homo sapiens
  misc_feature (11)..(11): n equals a,t,g, or c
  misc_feature (23)..(23): n equals a,t,g, or c
  misc_feature (38)..(38): n equals a,t,g, or c
  misc_feature (60)..(60): n equals a,t,g, or c
  misc_feature (73)..(73): n equals a,t,g, or c
  misc_feature (2101)..(2101): n equals a,t,g, or c
  misc_feature (2131)..(2131): n equals a,t,g, or c
agagccggggnccgtgctgaccncgggggggacggggncggggaaatgggaaagtcccgntttgcggttaagngcccgattgcaccactgcactccagcctgggtgtcagagcgagaacccgtgtcataaataaataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagcttccccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtaggaccttagagatgttcatgagaaactatttgytatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcataaataccgacatattacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttgccttagaggttagacttttgaagaaaaaaaaaaaaagntacagatcttttcccctggsscaaaggggnaagttgtwtttaggtctgtgacatctttgtggatggcygttttatcctggggtttgaccatgg

SEQ ID NO: 4895 - DNA, 351 bp, Homo sapiens
  misc_feature (78)..(78): n equals a,t,g, or c
  misc_feature (183)..(183): n equals a,t,g, or c
  misc_feature (318)..(318): n equals a,t,g, or c
ttctgcaattctgttgaatatgaaatgccatagagctttatttatttatgtaagtaaaagctaaatgaggggccaggngcagtggctcacatctggaatctcaacactttgggaggccaaggtgggaggatcacttgagcccaggagtttgagaccagcctgggcaacacagggagaccccgnctctataaaacatttagaaagttggctgggcatgctggggcatgcccatagtcccagctactcaggaggctgaggtgggaggattgcttgagccctggaggtcaaggctgcagtgagccatgattgcaccactgnactccagcctgggtgtcagagcgagaacccggg

SEQ ID NO: 4896 - DNA, 791 bp, Homo sapiens
  misc_feature (393)..(393): n equals a,t,g, or c
  misc_feature (753)..(753): n equals a,t,g, or c
  misc_feature (781)..(781): n equals a,t,g, or c
  misc_feature (788)..(788): n equals a,t,g, or c
ccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgntcccgctcagcctgcagcggaacatgatggcctccatccagtccttcagcgccatggccctcctcttctacaccgtgttyatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgsttyctcccttaatgtggtcamcamcttctamgtcatggtgggrgttttcaggtaagtcagttcaacgaggcaaggcgggnaagtggtcatgaatttcccccaactgtnaaggaangtc

SEQ ID NO: 4897 - DNA, 1761 bp, Homo sapiens
  misc_feature (1741)..(1741): n equals a,t,g, or c
agcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccaggscaagctgagagatggccagaaggatgccgcccccagggcagctggcactgtgaaggagctccccaagggcccggagcaggtgcccgtgccagaccccgccaggraagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcacccaaaaaaaaaaaaaaaaaggggcggcccgntttaaaggaccccaagttta

SEQ ID NO: 4898 - DNA, 840 bp, Homo sapiens
  misc_feature (500)..(500): n equals a,t,g, or c
gcttctcgcccattcaccaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcaggtgtgcagggaacagcaagatgtgcctcttgttcttgctgccacgcttccctgtgtcctggcgggcgggtgtggayggggctgctccttcctcacaggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcacngtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctgggaaaaaaaaaaaaaaaaaaaaaat

SEQ ID NO: 4899 - DNA, 584 bp, Homo sapiens
  misc_feature (84)..(84): n equals a,t,g, or c
  misc_feature (231)..(231): n equals a,t,g, or c
  misc_feature (496)..(496): n equals a,t,g, or c
  misc_feature (550)..(550): n equals a,t,g, or c
  misc_feature (560)..(560): n equals a,t,g, or c
tgcatagtccccccgacctgctccttgtatcgcaggcctctcacagggtcccagcttggccagcacaggttcttctgttggggncagtaagtcaggtgctgccattttgtgtggttcaacatgagcattgcttggtaccagccctgttcttggctccgtgctgtcaccctgtgtcagaatctccactgggcctgcacgtcctgtcattgcaactgcccctgccagtgcccncagcttcttttctagtggggctgactttccagaggccatctgggaaccttcttaggcagccatttccatggtgggggctccattcccgggaggggtacctgaggagattcccacaggttatttacatggtaggggttagcaactgggcctacgttctccagaaccatgggctgtcctgacagcgccagtggtccttggattcatgaggactgaagctgagagtcgtgttccatccacatgagaggggcagggtgaggagcatggnccgtgctgtgtattaaggaaatgcacgtggctcctgcttgtcatcccagcactntgggaacctnaggctggtggattgcttgagccca

SEQ ID NO: 4900 - DNA, 730 bp, Homo sapiens
  misc_feature (721)..(721): n equals a,t,g, or c
  misc_feature (726)..(726): n equals a,t,g, or c
tgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgwckgtggctgatggagacaaagatggccaggtttccttgggagaagcaaagtcsgcatgggcacttcttcaactgratgaatttcytcyccatgggtgataccttccaagrtaaagaacatacccccaaattaatggggwtcctgtggtgacctctatggtgaatggaaaakggttgaatatanccccncctt

SEQ ID NO: 4901 - DNA, 2350 bp, Homo sapiens
  misc_feature (2332)..(2332): n equals a,t,g, or c
  misc_feature (2337)..(2337): n equals a,t,g, or c
  misc_feature (2350)..(2350): n equals a,t,g, or c
agctcttattcttatgaaccttataggaaataccctgaaatattttggaaaagcaaaggagttgmcaggtttttttctccaagaaaacaagtgtaactaactttttaagaaaaaaagttgttatttcttgggcttctgttttacctgacaggagtcattatcccttatgttgtatgatgaacagctctccctaaaaatttggcaagcaacagaccaaccatcagtgggaaatatttcttccatccatttattataaccagatgatgaatgggaaaagtaccttaaagtaaacaaaactggtgctaatccatggcgttgaaggaaagttttgagagaaagctgtccagtgatggtcacatagatttttaacatgttccactttaggtaggcgaaacctttgagcagaaaatagtggatcttttctccaaaaggtgtttaattttatggagatgttgaaaggtacatgccaaatctgagtatacgtgtgaaaataatatgaaagaggagcaaatactaaaccttgtatatcaagtttacatggggaaaaaaacattagataaataaatacatttacatgcctctttaagaaatagccctttggcccacaggatatactgtttgaaaatggaaagttattactaaaaagtctgctataatttattttagtcttgcacttaacagtcccactttcacatagttcaaaatcaggatatgtggatcttgattgggccttaagatgtcagttttgaagggctcagtcagctgcgtgatactaagatgggccctttgaatctttaggaaagttcatccatttttagtcaataaaattggtgtactgtcaagtataagatttcttgaagtaagccacttgaaccattgtgaagctacacataacttgatgtctgaatgaggttaaaaatgggtgtataagtctttaatacagtaaaccatgctattaacccaacatctgttttataaagaagcaagtttaacctgctttgcagtcttaatttctgttaatgtgcaaactttaccatgctaagacattagtaaatttataaattttcttgttgaacagcagcttcaatgcaaacacaatgcttccagcattggtattttggctaaggtaaatctacaaatcactcactgttgatgtttatggaatgaagcttttcacagcattggtttttaaagtcagtcaaaatagttacacaatgaatgtacttcggagatgtaacagggcttctaaaagggcaggaatgacatcttggggacctgttgatcctacacctgccattacttcagtaatcacatactgatggcttctcaggcctggggggaaggagttttgtgtaactggcaggaatttgaagccatttttttttaatgctcaaaattgttctttaaaagtggcaggtttcttaaaatggtaattatgtccaaatgaactaagagtcattagtgtaggaaattttcttccacaataatgtttttaggttatttagtatcaaagaatgttccatttccatttgatttgctgtgactttgagagcaatacaagaataaagctgcttttctaattcttcacgaatttcacttggagcaccacgcagtaggtagtctttgagtaactgacaagcttttgccaagtttggttgtatcacttctgaagtacacttcattgtactctgatcacagctagttctacaatctgtgccatagacacagtccaaatcagactcacagtgacgatccttaataagttctttcaggtttgtctctggcacaatttttctcatatccaccattttcaaatcatacttatcattatatcctaggtttttggcactagtatcgcacatgaggaaatttccgtaggggccatggaaaacatcttccacaaattctagaagtcctatggctattttggcctttcttggccatgatggtgtgaacagctgatccatgcttcttctgaacccagatggaataaaaagttcaatgacccaaggaaggcttattccataaagagaggtatattcaacactttccatcacatagaggtcaccacagaatcccattaatttgggggtatgttctttatcttgaagtatcaccatgagaagaaattcattcagttgaagaagtgcccatgccgactttgcttctcccaaggaaacctggccatctttgtctccatcagccaccgtcaagatgagattaaccagttcagagaggtttccttggtcacccaattttgccttaaagagactatagaccatttctttaaatttttgtacagtagttcctctagttggcgkkatcaggatanctaanacttaaagttggn

SEQ ID NO: 4902 - DNA, 1898 bp, Homo sapiens
tcgacccacgcgtccggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccactgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgrgtccctccgcctcccagcgacggacgccaaagggtcccgggccgyctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccmtctgaggggtggcctggccttcggggtccccacgctcctttgcgaagtccactgtgggtgccatcatggtctccgggacctgggccagcgggaacgtgggggcactgggtgtkctgatataaagtcggcattactcaagctgcaaaaaaaaaaaaaaaaaaaaaaaaaagggcggccgctct

SEQ ID NO: 4903 - DNA, 513 bp, Homo sapiens
  misc_feature (423)..(423): n equals a,t,g, or c
  misc_feature (432)..(432): n equals a,t,g, or c
  misc_feature (496)..(497): n equals a,t,g, or c
tcaacaaggacaattaagggaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattatttctgtattccggararatgtgggttkgccatyctggtaggaaaatctgaattttcctaactttgaacnaaaaaaaantctttttggaacaactgcaaatggtattagtccatgaaatggtagaattttttttttaaccctnncaagaaaaaagttttt

SEQ ID NO: 4904 - DNA, 1463 bp, Homo sapiens
  misc_feature (1455)..(1455): n equals a,t,g, or c
cttgagtttttttttttttttttttttttttttttttttttttygaaacctaaaaatgtattttattttgaagttgtgctttggattttccccaatccaacatctgttgagtgacagtcttaggttcacacaaagcatctccaagcatacatacaatattccagttatcaacactattttaaagaatataccattttacacaaatgtgacatacaagtcagacgccacaacattgcgattccctggaagatgtgacttctcttctgcatgggaagtagatctgcaccagcccttccagtgctctgcgcatcccggtgctggcatcaccgctcctcatctccttggggagaagccagggcgccctgaggaggttggctgagaccagtgtttccagtttacaggctgctggctacaaactcctctrttttctaaattgggatgctagtagccccaccccacctctcttccccgaagactgacccttcagagtccacaccaggaaaaggatccatgccatgaggggtggagcagggctctttgaagcatcatgctggtttcggcaagcatagctgaggaaggctggtctccctaggccctggatggccagctccttttggcttttcggtgtaaaaatcacagtgtgcaacctcaattccagttgtttgcagtgagctctgccgagaaggactctcctcctatcggttcctagtcctctcgacaggaccatctcacaggtgttaggagcaccagagatggggaagacagctctgcccccagagctgggtttagtaggtgaccactcacacactgttcagttcatgatgcaaattagcgcggatggacactgatcaaggggatggtgaacacgagtcatgtacagggttgaaagagaaataaggcagrascaacagaacagscccaaagtgttgccattaagaaagctttgcttttactttcttagaggggagtgtgctggagagagggagaaagggcaagtgtgggtaccagttttgatcagttggattgaaaggaatgtaaagtgaaagatagggtttcattttcagcaaggaaacagatccttgggtatgaaagccccgttggctcgggacctgtgtaggcccaggtgacaggcaagaacaggtcaggaaacagcaacaaaaatcaagactgtgggttgcctcttctaggctgactcacttcactgaaagagttcttcagttctcctgcctagcacttggaaaggtttctctggtgctgcaggttagccttctcattagtgatttcccacaaagcacctcttttcctttgcacaggattaaaaaaaaaaatcctaccwctttccatagacctaactaccaatttcgcaggttggtccaaaaagaatctcttctaggtcaaaaataagaaaactcagattttcctaccagaatggcaacccaccatcttctccggccncgtgccaa

SEQ ID NO: 4905 - DNA, 2075 bp, Homo sapiens
  misc_feature (2073)..(2073): n equals a,t,g, or c
atggagataattatgagaaacctctgtttcttactgacgttagtggcaactctgttgctccccgggcggctgattgccgccgccggttcgaatggcagtgcgaagatcaccgctttgccatccggtttaccgtagaacttatagccttcgcccgctttcacgtacgggtcgttaccttcgctgtaacgccactgcgtttctttaccgttcacaccggccagcgcaraccgcgcgctttgtggtagtcatcgaacggtgccagatcgtgaccgtgamcgcgamcaaaccatgcgtwctcttcgaacagccctttttgcagatagaagcccagctcgcgggattcatcsctcagcygatcttccgccagttcggataccgggaatttgctcacttccggtgtggcwtacagcacttcgtacagcgttttgccacgcagttccggtttcttcgccagcagatcttccggccatacttcttcagttttgaagcggcgggagaactggactaactgccagagatccgatttcgcttcgcccggtgcctgtacctgttgacgccagaactgagtacggcgttcggcgttaccgtaagcgccctctttctctacccacattgcggtcggcaggatcaagtcggcggccagcgcactgactgtcggatacggatcggagacgatgatgaagttgcgcggatcgcgccagcccggcatacgctcttcattgatgttcggcccggcctgcatgttgktggtacacatggtccaagaaacattcagtttgccgtctttcagcgcacggtcttgtsccaccgcgtgcagaccgattttcgccggaatggkmccgctcgggatattccacttcttctcgcagatatcacggtgtttctcgttggtcaccaccatgtccgcaggcagacggtgarcaaaggtgsccacttcacgcgcagtaccacacgcagaaggttgcccggtcagggagaacggaccgcaacccggctgggaaattttgccggtcagcaggtgcaggttgtagaccaggttgttagcccacacgccacgagtatgctggttgaagcccatcgtccagtaggagatgactttcttgttcggatcggcatacagctscgccagttgttctaactggtctttcggcacgccggtcatttcggcagttttttccagcgtatactcggcaacgaaggctttgtaatcttcaaagctcatcggttcggaggcgtcagaacccggattcttcgctgctttttccagcggatgggtcggacgtaaaccgtagccgatgtccgtcgcccctttgcgcaggttaacgtgcttgctgaagaagtcctgatttatcgcattgttttgaatgatatagttggcgatgtagttcaggatcaccaggtcagattgcggcgtaaagatgatgccgttatccgccagctcgaagctacgatgctggtaggtagaaagcaccgccacggtgacgttctggttagagagacgacggttagtgatgcgcgaccagaggatcgggtgcatttccgccatgtktgcgscccacagmacaaacgcgtcagcctgctcgatgtcgtcatagcagcccatcggctcatccataccaaaggtacgcataaagccaactactgccgacgccatacagtgacgcgcgttcgggtcgatgttgttcgaacggaagcccgctttaaacagcttggacgcggcataaccttcccagatagtccactgaccagaaccgaacataccgatcgattccggccctttttctttcaggrcggttttgaatttctcttccatcacatcgaaggcctgatcccaggtgattggggtaaattcgccttctttgtcatatttaccgtttttcatacgcagcagcggctgcgtcaaacggtctttaccgtacatgattttgggcaggaaatagcccttaatgcagttcaggccacggttaaccggtgcgtccgggtcgccctgacargccaamcacamgtccctgctgcgttccgaccagaacgccgcaaccagtrccgcagaacyacccaattcgcgatatagtnag

SEQ ID NO: 4906 - DNA, 1285 bp, Homo sapiens
  misc_feature (599)..(599): n equals a,t,g, or c
  misc_feature (1109)..(1109): n equals a,t,g, or c
  misc_feature (1130)..(1130): n equals a,t,g, or c
  misc_feature (1199)..(1199): n equals a,t,g, or c
  misc_feature (1221)..(1221): n equals a,t,g, or c
  misc_feature (1274)..(1274): n equals a,t,g, or c
gagaccctaattttcggcagatccatgccttaaaggatcacagcagagcagagctttaaaaatgagtgccaacagaaatgagaggagatgctcccccaatcaacttaggatgtcttccttttttcttgtgcctcttttttttttgtcatctgaaatattacttgtcattattggggaacttgaggccgatcgatgaagtgtatatgtgtctgtcagacatttgaagaggaaaaacatgcttcaggaataaggaaaatgcctgcagtgaaagcaaagggtcaggatgagcttcagtgactgatgagttcatttcaaaatccaagggcacatagatggtaaattaatacatatggcaaatacagtcaacgagcaaaccccagccactggaaggaaagggaattttagctctgtagtcatcacatgcctgaacagagagtctacatatcttaaatgtagatccgaatcattgctcttttatcccgctaaatgctgattgcaaagaaatatttgggcattgttgactttccgtccataaagaaaggccaccaagattcacaaaatccatcacctgcactcatacatgcatgtgtgctttgaanttcccctaggatgtgaaacagttatgcagagaactggactgtgggtctyccttcctcamttctttccctccctgtttttccttttcgaaaatgtgatacctgatytctaggkcttgcgggctgagraattttktgtatttgkataatgcagtgtctggccttccccctgacctgctgatgtatttttggcctcattagtagtcagggagatgccttagtgcatccagcactgcaagtcagggatgagacacactacaacaggagagggagcaagcgcgagaggatattagaagagaggcttgtctccaagatatggaaggaagtgagaaatgacagggctgcaagctttgtatgtaggagcccggcagggcgggggagcggtgaggagagccaagtggattctcagaaaaggggggaagccatcgaagagctaaaggtgattagagggggatattgatttcttattctgccagagatttaagcaggcatgcgaggaatctgcaccatggntggcaaaaagagacccggtgnctctgtaaccagacactcaggcttttccaggagcccagggagcaagccgagaagaaagggggcaggtgnggtctaagaaaaatcaacttgncgcttgatttgggcctgagccctgctgtccgtcagcaaccttccttacaatcntttttttctct

SEQ ID NO: 4907 - DNA, 457 bp, Homo sapiens
ccttacaatctttttttctctctctccttttttttttccttgccttctccttcttcactgaagcctaggggagccagtaaagattaaatgtgcttctcaaaggcagccrcttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagaggtgagaaaaaagttgtcttgaaggtggrggtggrggggctgctaaacagacactgtacagagggagaagagacataatttagctgtgttgctagtatgattccatttttaaaggaggggagggggagagtctagagctctaa

SEQ ID NO: 4908 - DNA, 2138 bp, Homo sapiens
tggatgatgatggactcccctttcccacggatgtgatccagcataggttacggcaaatcgaagcagggtacaaacaagaggtggagcagctacgtcgacaggtgcgtgactcagatgagrctggacatccgtcactgctgtgcccctccagcagagcccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgraacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacamcttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagtaaaaaaaaaaaaaaaaaactcga

SEQ ID NO: 4909 - DNA, 2094 bp, Homo sapiens
ggttttttattcctgtggggctcaccccaaagtattaaaagtagctttgtaattccttgagcgcctggtttgactggggacttggggggatggggttggaagaatgactgccctttcccaccaaaaaagggagaactctttagattcagattgtgggtatgtagacttaataagtgaaacatcacagaagaagcctttattatacaatgacaaccaaacaagtactccggatatgcagtagaggaatcctctaagaaccatagagacttcttttctgtgatttttgttccccacccttgaacaccatctctaggatggagttggcctaagagtgaatgctgcaagatctgtgtttatgcctcttttcctcattcttcctcagtttgttcgtctgcttgaaagttggccaaaaaatcctgctgctcaccgacttcccgtggtcagctgctgtcaagcgttcactttctcttctgtcattcctcatggaatgagggtggttttgtcttcccgcttcccttgacctcaaaatcaggattaaaacctggggtagcctctgtgctcctttcttctatgccctggtttgttctgtggttctgggcttcttatatccgtgtgcccagggctgaactccttattttcctttctccaagggcagagccgagtcttcagtccctgttggtctttccccacccccacttccagcccaagagccaggaaagggctggtgccacactgtctgctgggatcagcggtggttctttgagctgctgatttgggtgttaggctcttgagctgggatgcagatgtaacagtagctccagtgagtcagacactctgcccagcacattagactgtgtttgaccacttcttccagttcatagtattgacttcagcccaaacggagataactccctgtgtgtccttgaggtattgagctgggctggacagctccccttgagccaactctaggagtacaatgtcaggggaaccccagtttgtgaaaaggacttagactggaggatatttgttatctggggatatgatgcggtggcggcggcgcctcaagataaggggctggggtttctgggtggggggccaacagagtggtgccagtaacagccccagatagaggagtacgcaggcccagcatgaggcaaccttgacccagaaggtggcccagctacccttgatgaaggtcttttccagttctgctccctcatagctgtgtaaccaaaggctctggttagagaatatgaagggccttagcttttagacctgttctacctcctcaccaaatataatggcagacccatgtgtgtctggaatggccttgaattgctctttccttaaaatagctagctcttcaggagagtatctaaggcccactccatcttacctgaaccagttggtaagggtaaccatgacatagagtgaggcaaggaagaagacgaagtggaaggcagaatagttgtaggaaagatgctggacttggactggaggagctggaggggtttcttggtcagctggcctcgcagccccacccctttgccctggagagaggaaatggctgctgggagcagagctgctgaaacacctcttcccctctcccccaactacctttgttaaggctcttgagggttcttatggcactccacagagatctaccacttcttatggttcctcacttggcactcacctttgtctgcctccactgtttcagggcagcagaaacacagtgagggcttctgcaaaacagaacgcaggttttggaatggtcttaaaagatgtgagggtgttaatctaggaaacttcccccgtgaaaagattggtctagtattaaaaagtggaggcacacctgggttcaaattctagctccagcatataagtggctgtgcagactttggtaagatgtttaatcttttgtgcctcgatttctccatttgtaaaatggagcaaatacctacctcacagggttgttgtgagggttaaattaaatgagattatgtaaaagtatctagcacagttgcctagcacattgtgggtactcaataaaaggtaacagcagctaaaaaaaaaaaaaaaaaaaacaaaacc

SEQ ID NO: 4910 - DNA, 510 bp, Homo sapiens
  misc_feature (5)..(5): n equals a,t,g, or c
  misc_feature (453)..(453): n equals a,t,g, or c
  misc_feature (470)..(470): n equals a,t,g, or c
agggnaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggmcagagtcwtttgatgtggtcacaaaatgtgtgagttcacactaactgagcagttcmtnggagaaatttgttgatnccggaaaccacaatagcgggatgatctccttaggacctat

SEQ ID NO: 4911 - DNA, 1213 bp, Homo sapiens
  misc_feature (1210)..(1210): n equals a,t,g, or c
gcgccacttcgagaacaccttcgtggtggagacgctcatctgcggggtggtgtgaggccctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaaaaaaaaaaaaaaaaaaaaaaaaaaaaaaaaaaaaaaaaaaaaaaaaaaaaaaaaaaaaaaaaaaaaanaaa

SEQ ID NO: 4912 - DNA, 915 bp, Homo sapiens
  misc_feature (5)..(5): n equals a,t,g, or c
  misc_feature (10)..(10): n equals a,t,g, or c
  misc_feature (15)..(15): n equals a,t,g, or c
agganaactncatgncactttgcccgaacctacccgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggagsccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctaaaaaaaaaaaaaaaaaaaaaaaaaaaaaaactcga

SEQ ID NO: 4913 - DNA, 165 bp, Homo sapiens
  misc_feature (126)..(126): n equals a,t,g, or c
tttttcttgctttcttgctttaaagtctattctggccgtgtgtggtggctcacacctgccaccagcactttgggaggccagtgggggtggactcgtgccgaattcctgcagcccgggggatccacnagttctagagcggccgccaccgcggtggagctccagctt

SEQ ID NO: 4914 - DNA, 1713 bp, Homo sapiens
  misc_feature (1127)..(1127): n equals a,t,g, or c
gaattcggcacgagcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccytattwattaatacctcttcgtatggagtcctttcctatcatgtatctggaattggcactcgcagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagcagctacatcatgngacagtggaattatagaagatgtgaagaaaacaacacacactccaacactaaaagcatgcctcttctcttctgtggctcaggggtatttkagaatggactcttctgcaacccagtttcacatagagactcatgagaacacatcaggactttggtcaatatggtaccgyaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaaaaaaaaaaaaaaaaactcga

SEQ ID NO: 4915 - DNA, 594 bp, Homo sapiens
ttttttttttttttttttttttttttttttttttttttttttcattaaaaaatttattttcatataaaagtgccaaaatatccaccaatgtcataatctatctcaataaccagtttacactagtaatcaaaacacaagcctctttattcacattgtttaaaaatccaattattttcacacattcccacagtaactcgagtctctagacagtgggaaatttgcattcctattcgctgtggtagtccatatgtccaggttcatataggcgcgaaacgggttgaaccccgggtagtattccttgcacacgaccgcttggttttccatgtgggtcgaatgttccgtggtggggttgatggggcagcaattttcatacacatcgctttgcggggcccagatggaaccaaaaagtccagacattggagacaagcttcgggtgcttgtgaggtagggckgaagtataaatgaggaaggaaaaataagttaaaagaaaaaaaaagccttagaaaggtgaatacatcagcgaatactacaatgctatcaagttacttggaagttattagactactctcaatttaaactcgtgccgctcgtgcc

SEQ ID NO: 4916 - DNA, 585 bp, Homo sapiens
  misc_feature (581)..(581): n equals a,t,g, or c
gaattcggcacgagcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttcttcagaattattttcttacctaactgaagaaggaagcatttaaagttccctattaataatacctcttcgnatgg

SEQ ID NO: 4917 - DNA, 870 bp, Homo sapiens
  misc_feature (22)..(22): n equals a,t,g, or c
  misc_feature (104)..(104): n equals a,t,g, or c
  misc_feature (106)..(106): n equals a,t,g, or c
  misc_feature (132)..(132): n equals a,t,g, or c
agaattcgccctttttaggtgncactatagaaaggtacgcctgcaggtaccggtccggaattcccgggtcgacccacgcgtccgggagacctgtggcccactcngncagtgtgtgtgacaagcagcttaaantgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaaaaaaaaaaaaaaaaaaaaaaaaaaaaaaaaaaaaaaaaa

SEQ ID NO: 4918 - DNA, 510 bp, Homo sapiens
ctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaaaaaaaaaaaaaaaaactcga

SEQ ID NO: 4919 - DNA, 774 bp, Homo sapiens
  misc_feature (697)..(697): n equals a,t,g, or c
  misc_feature (709)..(709): n equals a,t,g, or c
  misc_feature (716)..(716): n equals a,t,g, or c
  misc_feature (733)..(733): n equals a,t,g, or c
cggcacgagttttgggatgcctcttactctgccaagccgcttagcgggagggaacgtgttcctgatcatctttaccccaggcttctgtccggggcgtgtcaatgtagaaatcccccagcgaatgttggatgaatgaatgaagttgaagagagggtaggcggggaacgaggatgagggggacggctggagaagaggtatgggaggttcgatgtttcagggatggcacccaaggggggacattcgaggcagcaccggtagcacttcctttgcgatgaggggcgtctctttggacttcttggaaaagaggtgggcattggaaaccagggtctgggaacaaaccgtggtttggacataacatttgttaccttcacttttctgggagttggagaagtagaggaggaagttcagacaatttcataagtgtctaaaaagagacagttatgcgaccattgacgaggagtaaaagtcgtctattgagcatcttattcactacaaatagaagaaagaaataccagtttcctgacaagccccaccccatgcttggccagttcctgagtacacttaatatattttaggtactgtcatcaaactcaaagctcgctgtcagcctcaaaggtctgaaccctagtatagattcttgtagcttgcttgaagttacagtgggtcatgatcaggaattgatgctttgtttttgttntgaaacggagtntcgccantgcactccagcctgggngacagagcccgagactccttctcaaaaaaaaaaaaaaaaaa

SEQ ID NO: 4920 - DNA, 886 bp, Homo sapiens; identical to SEQ ID NO: 2370
  misc_feature (92)..(92): n equals a,t,g, or c
  misc_feature (886)..(886): n equals a,t,g, or c

SEQ ID NO: 4921 - DNA, 895 bp, Homo sapiens
tattggggaaagttggtaacscctgcaggtaccggtccgraattcccgggtygacccacgcgtccggtttggaatcaacttttgagcttcctgaggaatttagatttttgcttgtttcttttgtttttcagactcatgaaatggccacagatgataagacgtccccaacactggactctgctaatgatttgcctcgatctcctactagttcttctcatctcacacactttaaacctttgactcctgatcaagatgagcccccttttaaatcagcttatagttcttttgtaaatctctttcgttttaacaaaggtaagacttattaaagataagaggtttgattcaggtctgattgtttgaaatgctcctttgtctccagtggctcaccatgatcatatagtggttagtactctgttcagctttaatgctgggtctgtaagaaagtgaaatattaacaagcgatagctttaatcgtaggtctccagggtttactgctgaagagaaagctagaattttcactgwaataaycattaattattggtaactaaaggtctggattaaaagctaaatgttaggccaggcgtgatgcctcacacctgtaatcccagcactttgggaggctgaggcgggtggatcacgaggtcaggagatcaagaccatcctggctaacacggtgaaatcccgtctctactaaaaatacaaaaaaattagccgggcatggtggcgggcgcctgtagtcccagctactcaggaggctgaggcaggagaatggcgtgaacccaggaggcggggcttgcagtgagccgagattgcgcgactgtactctagcctgggtgacagagcgtgactccatctcaaaaaaaaaaaaaaaaaaaaaaaaaaaaaaagggcggcc

SEQ ID NO: 4922 - DNA, 371 bp, Homo sapiens
ggaaaaatatgttaattaccatatccctggaactccttctcaggctggtgggggcagccttgcaagagaaacagcagcctttgtctcttccctcttgtggggagcaaggaggggatgagcggtaccttgggagacccggtaaaagtctaaagaattgagaatttgactatcttgggggtaaaatgctgtcataggggcagcartctcagggggtgtaaactctggaatccactatggtttaccttgagtggcctgcacgaacatgacagccctgatctgtatttcctttccattcagaaaaccttaaaaaaaaaaaacttgttttatgataatattataacaatcataactaaaaaaaaaaaaaaaaaaaa

SEQ ID NO: 4923 - DNA, 221 bp, Homo sapiens
  misc_feature (217)..(217): n equals a,t,g, or c
cccacgcgtccgctttttaaatacttgtattaatctttatatgacctgtaggaatgctcatattttcattcttatcgttttggttctttcagtcttgccagggttttatatattttatgagtatttwtgaagaaccagttgctgactttgttcatctctattgtgttttctatttccaaggttgctcttacctttagtagttccttttttttttttngggt

SEQ ID NO: 4924 - DNA, 691 bp, Homo sapiens
ccattttgttattgtttaactttgtgtattgaatgactcattttwagtctctcttttctaatatgcacatttctaagcaggtctgcctatatgctctctaaatactgctctagctgcattccacatattttaataggatttgacagttttaatttccatgactttttcccatgactaattagaaatgtttattaattctcaaatacatggagctttcctaaagatgccttttatactgatttctatctgaaatccattgtggtcagagaatactgtgtgttttgtagcaatcctttgaaatacattgagacttgcttaatttgcaagtacaggttttcatatttttccatatgtgattggaaaaatattaatttgacaatttggggatatagtatacacacaatacacacaaacatatatgtattttcagtacttcaaaatttctacatatttcctggtatttgtctgcttgcttcattaattactgagagatgtacgattttgagttgtactttcttttgttgctctctcatttttctttcatatccttatggcaattgtattaagtgcataccaatttaaaattatttcaccttcmtsmatgtcaccttttattacacaaagtgatattttctattaattcgcctaaataaactttgcacttgaaaaaaaaaaaaaaaaaagggcggcc

SEQ ID NO: 4925 - DNA, 1001 bp, Homo sapiens
gctccaccgcggtggcggccgctctagaactagtggatcccccgggctgcaggaattcggcacgagcttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgcrcactrgatacgttattcagaaacccaaggaatggctgtccccatcctcatgtggctgtgtggagctcagctgtgttgtgtggcagtttattaaactgtcccccagataaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaac

SEQ ID NO: 4926 - DNA, 960 bp, Homo sapiens
  misc_feature (909)..(909): n equals a,t,g, or c
  misc_feature (951)..(951): n equals a,t,g, or c
ggcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcacccygggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgscaaatactggatgtacatcattcccgtcgtcctgttcctcatgatgtcaggagcgccagacamcgggggccagggtkggggtkggggtggggktgktgktggggtagtggccggtgagggcccaagcttgtcagcgttcccgtcttgcaaaacccaagggggcttccctttctgcttggaattcccctngtgttcctcaagcccatccccaaagaaagggttttgcttggntccccttcc

SEQ ID NO: 4927 - DNA, 1254 bp, Homo sapiens
  misc_feature (10)..(10): n equals a,t,g, or c
  misc_feature (16)..(16): n equals a,t,g, or c
  misc_feature (1188)..(1188): n equals a,t,g, or c
  misc_feature (1196)..(1196): n equals a,t,g, or c
  misc_feature (1226)..(1226): n equals a,t,g, or c
  misc_feature (1230)..(1230): n equals a,t,g, or c
  misc_feature (1248)..(1248): n equals a,t,g, or c
atccccaagngaacanaagctgcagctccaccgcggtggcggccgctctagaactagtggatcccccgggctgcaggaattcggcacgagcttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaaagaacgtggactccaacgtcaaagggcgaaaaaaccgtctatcagggcgatgggcccacttactngaaccatnaacccttaattcaaagttttttttgggggntccnaaggtgccccgtaaaagncacttt

SEQ ID NO: 4928 - DNA, 568 bp, Homo sapiens
  misc_feature (470)..(470): n equals a,t,g, or c
  misc_feature (539)..(539): n equals a,t,g, or c
  misc_feature (557)..(557): n equals a,t,g, or c
  misc_feature (565)..(565): n equals a,t,g, or c
  misc_feature (567)..(567): n equals a,t,g, or c
ggcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactcckggatgtggcagccctgaatggcctgtaccgggtccggatcccaaggcgacccgggrccctggatggcctggaagctggtggctatgtctcctcctttgtccctgcgtgctccctggtggagtcgnacctgtcggaccagctgaccctgcacgtggatgtggccggcaacgtggtgggccgtgtcggtggtgacncaccctggggctgccggngccatgangng

SEQ ID NO: 4929 - DNA, 758 bp, Homo sapiens
gaattcggcacgagacacggtttcaccctgttggccaggatggtctcaatctcttgacctcgtgatctgcctgcctcggcctcccaaagtgctaggattacaggcatgagccactgtgcccggcctttgttttttgagaccttttttattttgttgtcacccaggctgaagtgcagtggcacaaacacagttcactacagccttgacctcctgggctcaagcaattctgcctcagtcccacaagtaggtgggcttacaaatgcacagcatgacacctggcttatttttgtattttgtgtgtgtgtgtgtgagccactgcgcaggccttgggcagctttcttgatctctgttacctcatctataaaatgatgataataatagcttctcccttattggggaattgtaatgattaaatgagataacatgtaaaatgctcagtacaggccaggcatggtggctcacgcttgcaatcccagcactttgggaggctgaggctgctagatctcttgaggccagcagttaagaccagcctggccaatatggtgaaaccctgtgtctaccaaaaaatacagaaagtcagccaggcatggtggtgcatgcctgtggtcccagctactcagaggctgaggtgggagaatcacttgagcccgggagacagaagttgaagtgagccaagatggcgccactgcactctagcatgggctacagagtgagagcctctctcaaaaaaaaaaaaaaaaaaaaaaaaaaaactcgta

SEQ ID NO: 4930 - DNA, 1473 bp, Homo sapiens
ggcacgagccgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgtggcgtctgccaggcccccgagtccgccgagctctgccctcccacttgggcctgcacccagagagggtgagctacgtccttggggccacagggcacaacttcaccctccacctgcggaagaacagggacctgctgggctccggctacacagagacctatacggctgccaatggctccgaggtgacggagcagcctcgcgggcaggaccactgcttctaccagggccacttagagggtaccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactactgtggggtttgccagggtgtccgccatgtgctcccacagctcaggggctgtgaaccaggaccacagcaagaaccccgtgggcgtggcctgcaccatggcccatgagatgggccacaacctgggcatggaccatgatgagaacgtccagggctgccgctgccaggaaacgcttcgaggccggccgctgcatcatggcaaggccagcattggctcccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgac

SEQ ID NO: 4931 - DNA, 341 bp, Homo sapiens
  misc_feature (324)..(324): n equals a,t,g, or c
ggctggagtgcagtggcgtgatcttggctcactgcaacctctgcctcccaggttcaagctattctccagcctcaaccttccaagtaactgggattacaggcatgcaccaccacacccggctagtttttgtatttttagtagagatgggktttcaccatgttggccaggctggtctcgaactcctgacctcaagtgatctgcccgccttggcctcccaaagtgctggaattacaggcgtgagccactgcgcccagcttccatttcttcctttgaaaagtaagragggttgggaattgtcaccctggargttcatggttgctaaantattgaatcctgttgct

SEQ ID NO: 4932 - DNA, 388 bp, Homo sapiens
  misc_feature (23)..(23): n equals a,t,g, or c
tcgctgaccccagccccagtttntggctgcaaactcacagaggccccaggctcctgtggccccatcaccagcagctcctgctgtcatttcstgagcctcgcaagcccctaatcctgctccttcctgtcstggcccccarctccctcaagccccactcctgcatcccattctccctggacatcacccctcccaccccttggctcaatttccttcctgtcgtggcttggtcctttggtcattgccctggtcttttcttgtccccttcctgattctgcccttctccaggcccacacgggaacytcctaaccgctgagccctgaaaggtaggcgggkttaggatgagtggctacagggaggagaatggtgtggggagagagatatggaggaa

SEQ ID NO: 4933 - DNA, 679 bp, Homo sapiens
  misc_feature (655)..(655): n equals a,t,g, or c
  misc_feature (670)..(671): n equals a,t,g, or c
  misc_feature (677)..(677): n equals a,t,g, or c
aacccacccctcctctccattctcacgaccaccacctcactcaggccccagctgctgctgcctctccctggaccccacccgaggcccctgcagttcctgcgtcctgatggccccttgcaccacgctccacatggcagctggagggaggaggcttgtcacaatgcccgttgtgctatttcagctttggttatttatcttaaagacagataatgcatttgcgtggttgaaaatcaggaggtgagaagcctctgccctcttcttgggtgtccccatccccggaggtgctgttcatgagctcctggagggggccttccagaaaggttgatgcataccacacataccctccccttcccgttcgcacaaatgcagtgtgctcatgtcccactgtaaggcaaagcacacggcgccatcccgttccatggccaaggagcgtcccacagtgtgggctgtgctggaaccttccagccagcacctcatggacatctgcattgtttacggattttgctgtcatagacgttgtatacctctgcacacgctgtatgcttccagggatgcttttcttggaatggaatcatggggcattggagctcsgggctgaccatctggatccatcccacsgggtcagagagagcttcagaaaacagaatcatgatgntccggcctcccacanntcacanat

SEQ ID NO: 4934 - DNA, 2782 bp, Homo sapiens
ttttttttggttttgamtcywagttgacacctatttaacccaatctcttgggcataatatgcaaaatacccggtgtctgccacgcccggggatgggagtacaggtatgctggagttggaaactggagggtcagagttggctgatgctctcaggagacaccaggcaaggcagccgggctgagacgcctgcacttactcctgccgtgacgggagcacctaccaaacgtgactctaaggtccccaccagtgctgtgtgttacaaggaccgtgcagggtgsccgggtccatgcgagcatgtggtgcttgtgtgatttagtcttttttgggagatgaagggscagtggggscagatgactagagttaaggggtaggaatgggatagaaawtaagaactatgggtgacatcctccttgccctgatgtgggccactggactgctaactgcaccttggggctcacaggatgtcactgcagtgactaggccagtgagctccctcactcagcaggaatgaaatcagcctgggataccagctcccggagaacagacaccatggcccacactcgcaggcaccatgtacgctccacgaagggaagggggccttcgggaagcgccacccttaccacacagagcaggcacgcagctctcccgggcaacgtcccaccccactcaccttcgaaggtaaggaagggtttttcgtgaatggatccgaggtaaatgggtcattctttgtctgtttcttgaagaagtcgtcagtggcagagccacggaatgggtcactttctttgaaagggtcccctccaaatggatctgttgaagttgtctgctgttctgcaaaggggtcattctggaacgggtcgcctttgaaggggtcagctcctttaaatgggtcagatttgaaggggtcttctgtctggaaaggatccggatgcaactcttgcgtgttgttgctaaatamcaaggctttatttttgaaaggatcatccatggctccaaaactgcccctctctgccagggagacgccttcgctcaggttggccaggtcggtcaggctggcaccatgggctccatcgagcacctggtcatactgctccaggctcctgtgggcctcctggcggctttcatgcagctgggaaagtttgctccttgcctggttgatttcgtcttgcgttgacttcagggacttgatgatggtttccagctggactcgcccagcctgaatgctctgctccagctgggtttcctcctgctgcaatcggttcagctccgacttggctcggttcagatcgtcttcctgggactttaagtcagattcctgagattggatttgcgttttcagtgatgagatcatctgagtctcatcctggcacttctgccggacgtcgctcagcatgtctcgragcttggccttctgctggtccatctcgtccaggcggtcttgagcatcctgtttctgagcctcgagctcctgcaaactgcttgtttcccggtctaggtcattttgtaattcctgcacctcgctggttttctgtctgattgcctcttccttttctcgaatgtcttgttccagtgaatatttctctctttgtaactgggcaatctcttgactgatgtcatcaagctccttcacgccagtaaactccccggagccgagagagcctgaactgtccgggccgggcgtgcctctctccgaaggcgggaccatgtccggcgagaggacttgaggagggtcgatgcctttactgaccttctgctgaatgaaatacatagctaacgcgaattggtctttgcttaacttccccgtttgcctcgtatcggccagggcccatatgtgtgctagaaggttctgggtgaggcccgagtgcatgaagatctccttcacctcctggccactcacgtagccatccaggtccaggtcggtcttcaggaatatctcatcaaatcgcatcttgtctgccacgggcaccacccagttcactgttggctgtgtttgcttgaggctgtgcttgggggacaggctccctgtgctgttgaggctgctgacgctgccgtgggacggcgtggagcggaggctgtcttttggtggggggctggcaggcaggacggggacggcgccagggaacacagtcttctttctcttggagggtgggatgagggacgggggcagggcggagggcacgggctccttctccagggctcggtacaccaagtgcatggccacagcgaactcatctcgatccaagtgcccatccttgtcaatgtcactgaggtcccagaccctgcccaggacatcaagaggcagctttgagttcatgaggactggcttgactttgtctccagagagcaaaccattgatgggcaagaggctttcaaaaatcccatcaaatttggccttttcttccaccctcacagcccagtgggcctctgcagagggcggtgtgaccatcagagggctgctggtgtcgtgaaatttaggcggtggcatgctcaaattcagattgctcaaggtaacttcatggccactctgtgcacaggccaccagtctcagtgcaacatagaaaccctgtttgtccaagaaccctttaccttctggatcggccaagtcccatatcttcccaaggataatgtccgagaggccagacttctttagaaaaagcgcagcttcactcgcccccaccctccctgtgtatgccggatcgacctgcttgtaataagattcatacaacgaatttccagtgggaatctgmtgggagagggggatgagcggcgccgccatcttcccgcgg

SEQ ID NO: 4935 - DNA, 1121 bp, Homo sapiens
  misc_feature (2)..(2): n equals a,t,g, or c
  misc_feature (13)..(13): n equals a,t,g, or c
  misc_feature (21)..(21): n equals a,t,g, or c
  misc_feature (40)..(40): n equals a,t,g, or c
  misc_feature (47)..(47): n equals a,t,g, or c
tntgggggtgtcncttgcccngatgcgcttccttttgaanaggaacntggggggatcccgagcctcgggctgaccatctggatccatcccacggggtcagagagagcttcagaaacagaatcatgatgtcccgcctcccacactcacacatcccaccgggctccccaccacagagcccagcgcagtctccttggcgtggcctgtggggtgcagcctctgatgcctccacccattcccttttgctctagctggagtgcgacaccccccgaccctggggtccctgtggttccctccgccaggctctgtccctggctcttcacctgcctggcacctgctcacctgttggccccatcctawatgctgcttttgtgggcatcttccctgcccacaaggtgtgactgtagtttccctgtgacccccttggtgccacttgtccacgttatttgcgtttgggtgatgttcccctccgcagccacagctgcatgtcatccgggagctggggcctttttctcacagggacccagccccttctctcgcacctggcctstgttaggccatcgggaaatacctgctgagggagctggtgagacagtggccctgggcctccagcccaagaggcacacattggccgtgggtgtgcacggaatgctggccctgagcacggtcacagtgggtggtttcggaggcttcccctggacttctggcccaggctgccccccgttatcttggacatgcttcatttttcccatcctcacgtaaacccctgcaactcctccctaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgaccaagtcggagctgaaccgattgcagcaggaggaaacccagctggagcagagcattcagctgggcgagtcccaagctkggaaamccataatcaagccctgaaggcaa

SEQ ID NO: 4936 - DNA, 1218 bp, Homo sapiens
gtgcaccagcacacccagctaattttttcattctttgtagagatggggtcttgctatgttgtttggcctggtcttgaactcctggactcaagcaatttttccacctcggcctcccaaggtgctgggattacaggcatgagccaccacgtccgtgcccaaatatgtatttaatttaaatttcattttaatgtgtttaagggatgaaagtaaatacatgcttgttacaagccattcaaatgtagaagtaggaaggtggctgcccggcctcccctctcctgggaggatctgtggtgagcagtcggatgtgcatccttctggtcttttttctattaacgactctttgctggatttgctgttactaggctttcgcagcaaacgtgggattgttgtggaaaatgctttgctgggagaaggggagccggagattcacaaaaggaggctcccgtgttcatttgcgtatttggcagctcctaggctgggagtcaggatacctgggttcccgtccctgctctgccactaactggctgtgagagctggggcaagtctgctctgggtgcgtcttctgagagtcacattctggttgtctatgcagctaggggtgaccctggcgtgagtatctggaacaggccaggcttggctccctggccgggggtcttgtctgtcgagtgagcacctgagctggggtccctgagatctkttctgaggctgcctctgtcmtgcagcactttgagatgcgccccccttggagccctccaggagctgagaatcagaagagatcctgtggggagaggtgagattttctgtacctctgtttccttacctgaggtgggtcataacaaagctctgccgcttggtagtgctgaggattgagacccccaatgcggtgtgcttagaacagtgcctagcgtgtcataagcacaggtgaaatatcaggcattattctgaaaggcggcagggtatcctgtgtaagggaatgctgtttattacgtgccgccttgtacgcttgtctcgttattgcttttggacaaattttcagaagaaaatggtcagactctggggtcggcacatttttaggacgtttgcggcactctggcaccctgccctccagaaaggccatttgattttcaggcatagagacagcctggagttccctgccccacttccccggcaccccttcttcatctgatacgtaagaaaaaaaaaaaaaaaaaaactcga

SEQ ID NO: 4937 - DNA, 1887 bp, Homo sapiens
  misc_feature (5)..(5): n equals a,t,g, or c
  misc_feature (87)..(87): n equals a,t,g, or c
  misc_feature (100)..(100): n equals a,t,g, or c
  misc_feature (149)..(149): n equals a,t,g, or c
tgggntccgatgaagaaaccctggcaagccagtgcgcccgaaaaaatggcccacctataaaggcttatattctggttaaagggccanaatgggcgtgggntaaaaccgccggaatggggcctcgcaaatcacttggtgttccggccagncaaaatcatcaaaatgggctcgtgaaatcgggtaktaccaaaccggcgtttatcagccaggatggggcccgcagcgtcacgctamcggtgaaatcgcaacccgtgctatctcgatgctggcgattctgaccggtaacgttggtattaacggaggcaacagcggcgcgcgtgaaggttcatacagcttaccgtttgtccgtatgccgaccttggaaaacccgatccagaccagcatttcgatgtttatgtggaccgatgccattgaacgtggcccggaaatgacggcgctgcgtgatggtgtacgcgggaaagataagctggatgtgccgatcaaaatgatctggaactatgccggtaactgcctgattaaccagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcgctggatgcatcctgcgggaatatgtcttacgtgattttcaacgatcaggtgattaaaccgcgctttgaatgtaagaccatctatgaaatgaccagcgaactggcaaaacgtcttggcgttgagcaacagtttactgaaggccgtacccaggaagagtggatgcggcatctgtatgcccagtcgcgggaagcgattcctgaactgccaacgtttgaagagttccgcaagcaggggatctttaaaaagcgcgacccacaagggcatcacgttgcttataaagccttccgtgaagatccgcaggcaaacccactgactacgccatcgggcaaaattgagatttattcgcaggcgctggctgacattgccgctacctgggaattgcctgaaggcgatgtgatcgatccactgccgatctacacgccgggctttgaaagttatcaggatccgctgaacaaacagtatccgctgcagcttacaggtttccactataaatctcgcgttcactcaacttacggcaacgttgatgtgctgaaagcggcttgccgtcaggaaatgtggatcaacccgcttgatgcccaaaaacgcggtatccacaacggcgataaagtcaggatctttaacgatcgtggtgaggttcatattgaggcgaaagtgacgccacgaatgatgccgggtgtggtcgcactgggtgaaggtgcctggtatgacccggatgcaaaacgtgtcgataagggtggttgtattaacgtactgaccactcaacgtccgtctcctctcgctaaggggaatccgtcacatacaaaccttgttcaggttgaaaaggtgtaaggagtaaccgatgacaacccagtatggattttttattgattccagccgttgcaccggttgcaaaacctgcgagctggcctgtaaagactacaaagatttgacgccagaagtcagcttccgccgcatttatgaatatgctggcggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtgtgcattggctgccgctactgccatatggcttgcccgtatggcgcaccgcaatataacgaaacgaaaggccatatgaccaaat

SEQ ID NO: 4938 - DNA, 1446 bp, Homo sapiens
ggcacgagcggaagtgcaactcgaacttggtcggggcgcggatcccgagagggaaagtcataacaaccgcacgagggagttcgactggcgaactggaaggccacgcctcctcccgcctgccccctcagccctgtggctggggcagagctcagactgtcttctgaagattgatgtctatttccttgagctctttaattttgttgccaatttggataaacatggcacaaatccagcagggaggtccagatgaaaaagaaaagactaccgcactgaaagatttattatctaggatagatttggatgaactaatgaaaaaagatgaaccgcctcttgatttcctgataccctggaaggtttgaatatgcttttaatgaaaagggacagttaagacacataaaaactggggaaccatttgtttttaactaccgggaagatttacacagatggaaccagaaaagatacgaggctctaggagagatcatcacgaatatgtatatgagctcctggaaaaggattgtaatttgaaaaaagtatctattccagtagatgccactgagagtgaaccaaagagttttatctttatgagtgaggatgctttgacaaatccacagaagctgatggttttaattcatggtagtggtgttgtcagggcagggcagtgggctagaagacttattataaatgaagatctggacagtggcacacagataccgtttattaaaagagctgtggctgaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaaccgacgtgatttctatgagaactatcgtaacccccaaagagaaaaagaaaggatgcaattgtatatcagagaaaatggttctcctgaagaacatgcaatctatgtttgggatcatttcatagctcaggctgctgctgagaatgtgtttttcgttgctcacagctatggaggacttgcttttgttgaactgcaactcatgatcaaacaagctaattcagatgctgggaagtgctttcgcttagctatgtggaagaaccattgactgtatacaaccaacaagtgtatggtgcaacaggagatccattgaaaaccgtttataggactgaacgacaaccccaaatgcaagtgaccatgagcaactacaaataggtatacatatgcatttgagctgaacagactttctgacatataatttagtcaaaattgctgtatttcttccccttaaatttatacataatcagcttcttgtatggacccaaattggagaaatgtaattcagtagttggtgagaaataaaggattgtgacctctgtgtaattatcaggaaaaaaaaaaaaaaaaaa

SEQ ID NO: 4939 - DNA, 1944 bp, Homo sapiens
  misc_feature (14)..(14): n equals a,t,g, or c
  misc_feature (38)..(38): n equals a,t,g, or c
  misc_feature (40)..(40): n equals a,t,g, or c
  misc_feature (43)..(43): n equals a,t,g, or c
  misc_feature (67)..(67): n equals a,t,g, or c
  misc_feature (120)..(120): n equals a,t,g, or c
caaattgtcctgtnatctcggttctctatggatttaananaanctctgatttccagttcagtttttnttttttctgttgtgtgccaggagtgcagcttcactagttgaactcaaaactgnaagtagtatgaatttttcagtgtctgaatttgccttcaatttagtttgagtcccacgacttagaagtaggctgttctactaggagctttttaaaccattacagttatttaatttgattcatttaatctctattgaggatctaytaagtttcatgcatcttttattatgtatagtatttcatgcactggaaatattaagatgcttctatccccatacttcttttttcaaaggctttttctcattgttctctagaggatgggtctatctcttatattttgctaaagatttgttgccttttgtattttatctttccttctattagcaaatgtttttctctattagctcattctcatgagtatctaattatgctttcatacatcatcttaaggaagccaccttgggtctttccacaccccctaacttctgcaatctctgttcactttcattatcaagagttgtctacttatattgttacaatctctcaaatttagtttacttttcaatctattccattctggttgtcgcttctgataccactgtgaatgctctgtcatcagggtcctccctgttgcaaaatccttcttctctgcgtgccacatactcctacctccccacctcaggctctggcagccacagatcttactatctgtctagttttgcctttcctggaatgtcatagtgttggagtcatgcagtgtgtagctttttcagactggctttcacttagcaatatgaaagtttttttcatgtctttttgtgacttgggagctcatttcttattattgtatatatctaccacagtttgtttatccatcatctaatgaaggacagcttggttgcttgatgtttttggcagttctgaataaagctgccgcaaacattcctgtgcaggtttttatgtggacttgttttcaactcatttgggaaaatacctgtgtgtgcaattgctgagtcatgtagtaagcctgtgcttagctctgtaagagactgcagactgtctcaactcgactgtactgtttttgcatttccaccagcaatgaatatgaattcatttgctmtgcattcttagcagcatttggtgttgtcagtgattgtagcctgtctaataggggtgtggtagtatccattgttttaattagcatttctctagtgatatagggtgttgagctccatttcatgktttttttttttctctattatctttggtgatacatctgctcagattttttgctcttttttaagattttttctttattgtgtgttaagagttcttggtatattttagataccagtcctttataagatgtgtttgacaaatattttctcctagtctgtggcttgtcttttcattttttttaaacagtgttttacagagaagaaaaattttcaattttaatgaagtctaccttatcaattttttctttatgggtcatgattttcgtgctgtgtttacaaatatattgccaaacaagattttcttcctcattatctacaagttttacagttttgaattgtatgtataggtctgtgatactttctgagttaacttttgtgaaagataaaaggtcagtgttggatagattatttttccttttgcatgtggttgtccagcaccatgaagactcttccttctccactgaattgtctttgtacttttgccaaagatcagatttacctcttaaatctttgtcaaacctgtccacttctcaccatctccattttcaatctcttcggacgcgtgggcggacgcgtgggtcgacccgggaattccggaccggtacctgcaggcgtaccagctttccctatagtgagtcgtattagagc

SEQ ID NO: 4940 - DNA, 2209 bp, Homo sapiens
  misc_feature (2199)..(2199): n equals a,t,g, or c
cgtgctgtgtttacaaatatattgccaaacaagattttcttcctcattatctacaagttttacagttttgaattgtatgtataggtctgtgatactttctgagttaacttttgtgaaagataaaaggtcagtgttggatagatattttccttttgcatgtggttgtccagcaccatgaagactcttccttctccactgaattgtctttgtactyttgcyaaagatcagatttacctcttaaatctttgtcaaacctgtccacttctcaccatctccattttcaatctcttcaagccaccatcctctcttgcctaattattgcagtagtccttactggtcttgccttatctgttgatccctgttttattcacagaatatgatttgtgattttaaaggcataaataaaatgccttttctgtttaatatctaattgctttcctttatacaaacaacaaaatccaaattctttatcatggcctgtgagaccctaaatgatcaggccctaccttttcttccaactttaccctcattcttcctctccagccacctttggctcatttagtctctgaatgtgttactgtctactaccttaggggattcctaatgactggaatgccccttttaagtctcagcttaaatgtttcctcttcagggatgccttttctagtcattatatctaaacatttagttctcttccttgacttttactctctaacattacatcaattctttactactattttgcccaatttaaaagcatatattgttggtctatttattgtctgacttcctgaramcagggatcacgtctgtcttgttkgctattgttttttttagcagctgctacacagtaggcgccaaacaaatattttaaggaagaagacataggcagcctttgagatgcccaaatttagtgaggaagatccatatgtatgtaggtaaattatagtgccattttagtgctgttagaaagttgtagttttggaaaacaagtaatgaaaggttaagaaagaaaaatctttcggattcttcctcaagtgtgtgaactttatagctgtcaatttatgaagtcttattgsctaggtttcttttttttttttttccattctttgtcacttttattcagtagtaggttttttttccttattttcagtgccagacacggcgaggagtgattacagccaactgttactaaaacatttgtttgcaacatataccccctttataccactgaccccaaactgactcattttgtgtgctttcattctttctttttttaatataccaccaccaagaccgggtggagggggcaagggtaagagatgaaggggagcagtccaggaggccagaagaggaggaatgctacaagccacagtaagaatgagctgtatttaatttaaaaaaagggggaaggggtgtaccccacaaatgatacagtaatgaggatacacaattaaatcccatagcatgactgaaggctttcactgtgtttgacgtcatcacaatggaattgcctaggtttcttagctaaaagtaagtttgkatcttttattatttgatagtggggggttagcgycctagaagtcccagacttaggttctcaattgkcttaagaaaccatccatctgtattgacaatatgggtgctctaggggcagtcttaagcccaataagaggtcttttarcgcactgagcttttgctctctagggtcagtgtttggatttgaatatccagcactgccactcaccttgggcaagtcatttaaactgcatgtctcagtttcctcatctgcaaagggactaataaacacacctacctcctgggatggttttgaggaatacattggctaatatatgtaaagcatttactatgtgccagaccctgcaataaatgtgaaagtagtctctgttactacataaagggcttctcatttagccaaaattttattacattctagtacacttacgttgagtaatatgcagctttttcagtggatacttcatttcaaccttacagagaaattagaaaccatcagatgggatatccttcattctgataccaaacataaatctgacatgtcaacaccccttccttcagcttcacctatgctctatatcttatcacctctgctatctgagatcttaagatttttaaaaaattacttctttctcatatttaactttttcctttcaactaganccttctctta

SEQ ID NO: 4941 - DNA, 842 bp, Homo sapiens
  misc_feature (1)..(1): n equals a,t,g, or c
  misc_feature (3)..(3): n equals a,t,g, or c
  misc_feature (5)..(5): n equals a,t,g, or c
nananccagtaatttggataatattttaattcagcaccaagtagattgtttctcacacctgtgttggaagttactggtttagagtatggtttaaaatttttttctctcataggcctttaaaattaaaataatttgcatgttaattaaattccagccttaatagggttttccatcaccttaattcccacatttgtttttcatttccaacatctttgaacttttattgaataaaataattgtacaatcttagataaatattaamccaaaatttgatgaaagtaatactgcattcatgatactttgctagctagatactataattagaactgaatgaaataaacaacctgtttttaatttttcccttttttgagggatgacacagtttgcctaattagaaataccttttgtgactgtcgtttgtttacctctattttgcagcagcatagcacttctgagatgtttaacttcttttttcatcaaaattattttgaacatgctgacatatctttgagatttaattcctagtcatttaaagaaaataaggggctaggggtggtggctcacttctgtaatcccaacacttggaggccaacgctggaggatcacttgagtccaggagtttgagaccagcctggacaacatagagacctgtctctacaaaaaaaaaaaaagttagctgggcgtggtggtgcacgtctatagccccagctactctggaggctaaggtgagaggattgcttgagcctgggaggtccgtgtctgcagtgagctgtgatcctgccaatgcactcagcctcggctcagtgagaccttgttaaaaaaaaaaaaaaaaaaaaactcga

SEQ ID NO: 4942 - DNA, 352 bp, Homo sapiens
  misc_feature (347)..(347): n equals a,t,g, or c
ttctgggaatgtcctccccgtatttratagtggtccctgaaatactacttggtatttgtaaacaaatgtctgtggtttgccttccaaggactttaatgtaggcttatctggctgaaraattttgtgaraaatgctcacgttagtgtcttttgtctttctcttgctcttgttagagtctatgatttagaggatgtatgcttggctgtggaatatctcggagctgaagagaagaaggccaggtcttagcatyctttctatataaatgtttycataccttaccccattttcaatatggtacaycctyctccaccatacakgtttctctcaattttaggaatgtgtttccnccaaa

SEQ ID NO: 4943 - DNA, 597 bp, Homo sapiens; identical to SEQ ID NO: 2423
  misc_feature (12)..(12): n equals a,t,g, or c

SEQ ID NO: 4944 - DNA, 938 bp, Homo sapiens
  misc_feature (200)..(200): n equals a,t,g, or c
ggcacaggaaaaaaaagaaaaaagaaaaaagaaaaaagtttttgtacccacagattagcattttcttgatgtttgaaaaaagtttaagctatgtcctaatttaaaaatgagcacaaactacttaacagatgtctgttccctcttctcttacttaaattatctttattttcaccatcacctcccagtgccgaacacctganctctgtgttttgtggttggatcctgggttgccaagttcctatttggtcagtccctggcctgtggggcggtctcaggaagtggcatgctcttcamgraggatcgttcatytccagtataaccawtttgttaataatagttgataattcccagcttttaccagatgarttttgacttatttttcctcctttgacctgttcaaagctaacatatctcggtcagttcggagagggtgggggatttgagaatgtgaggaggagtggggttagaatgggtttgcctatctgggcaaggaaagagttcctagtcgattgggcacaatgacaaaatgattccatggatagaatcgtcccatgttgctggaacacctcacgtgttgtgaacgccttaaattcctgccatcccttctctgattccccacctccctgtagtttccacaggatttatctctctgtacccccgtcctccaactctactctgtcagcctctcctccatcccttacttcccttctaaattccaggagatgacctcactttgcaaagcaaattggagccaccaaattgtagctctcctcggtggaaactgcatctgtgctcatccctgcaccttcttgcagaaagccgccccctcaggccaagatgagtgcctggcccccatgggagactcagacactttgaccccttgtgacttcagcatctccctctttaaagattctctcccaacattcagtcgtgctcga

SEQ ID NO: 4945 - DNA, 909 bp, Homo sapiens
  misc_feature (824)..(824): n equals a,t,g, or c
  misc_feature (841)..(841): n equals a,t,g, or c
  misc_feature (891)..(891): n equals a,t,g, or c
ggattctcctgcctcagcctccggagttgctgggattacaggtgcacgctgccatgcctggttaattttttttatctttaatagagacggggtttcaccatgttggccaggctggtcttgaactcctgacctcatgatccacccacctcggcttcccaaagtgctgcaattacaggcatgagccactgcgcctggccacctttgctgatttttataaccagggttcagtgggcaacagcaaccaagtgtcagtttacagccaaatcagggattggactgactcaaggctgcagttcagtatttgtaaaactaggtctatttctgatttgtccctatgattgggaatagctcttgatttggcaagtgaaagcctaggtgttttctagattacctcctgctcagcatggtgagattgtggaagctctgcttaagccagcttcttatcaaatgctttctgcttggtttagcagcctgactacgtgctacttatgcatagataaatgttttgagaagaaaaatatctcctattattatactcacttctttgtgctgccttctctcttaatccctctctcctttggtaaccctaagctccaattatgcccaaacctctgcttagccaccactttctgcttggcatttaatgtctcatcctaaactgattataagccagcaaattccttgagaaggaaaggagcatagaatgtcaggctaggctcacctcagtgagtttccttttctctcagacaccttacttggcccctcaagtcctggcttccattggtaacactctaatgctttcaaccattcttaaaattaagctnttctgatgcttgtttgntagtaggaggtttggtctgttgtaaattagtctgatgcaactgacacagntgaaagtaaagtcagttg

SEQ ID NO: 4946 - DNA, 1765 bp, Homo sapiens
tccagcccgccacctctggactccctcccctgtatgtaagccctcaataaaaccccacgtctcttttgctggctctgggtctctttggcgtcttgaaccttatgccttccctattgaagttaataggggttcagcacaacactgggtcccaggcatgcagccttgtctttttatgtttgtcctcatgggcatcatgtgggccacagggatcttacccaaaatcatgcctagcaggaagagatgcctctctattgatattccagctgccccacaagcaggtatgtgcctactcattctctgacatgtgtcctaggtttcttgactgtaaaattccgcttaataaataatgtattgagcacctgctatatccagagctctgctgggcactctggaagattagagtttgaagaacacacaatcgttgtcctccagaagttcatggtccagtagggagagaaggtcacaaacagccagaatctacaagatgagaggggctattaaagagagctgagaagagtttcagagccactgagaagatactcattttagtcttggtaacgggaagctttctggagttggtggcatttaagatgaaccacaaatggagcaggaatttaatgaagaggaaaggaccaggacgttcaaatagaggacacagcagagttcagaccagatgcaggaaagggtaagtggtttggtttgctgtgaggtcaggtgcatgatggaaaatggtgagcagttagatgacaaagataggttagggcagttatggtgggagaaaccctgtttttgaagaaagatacagtcagatgggcacttcagcagcattattctgacagcaatgtgcaaataggatggagaggcactgaagaggcaggatgcaaggagaacaattcagacgcagttgacatcgcttgggagagaatgaggtactatccaggacagccccaagagagtggagagccctgtcctgagattcttgggaaaaggtgccccagtatcaacagcatgtgcccataagctccctcagcccacttgtcaggctgggtcagcttgtcccccaccccaccccagctctctcctctcctctcagagcaagccacctgccctactcactgctccaccatgatacacctgtcctgcctcagccacgtccccctctgaccatttcccccttttcaggaaagtgcttgcagtttgctacctcccattctttgcagcctccttccgcaaagctctcaccttgtgtcatctttgcctgtgtgccctatggagaaggaaaacaaagtaagcgctgtcttcccagggctgcaggcgtgctggccccctaccttcatgcactcaaggagcactgactgagcatcctgcaactctgtcctgtccccagaagccatgctttgtgagaagtggggtaagcatcacagaagctggccactggcaggcgcatgcagggcttcagacctgctcctgatgtaatctttgctgcacattcacctcacctgaggacctgtggaaactagcacccaggtcacaggccctgctaattaaatcagaatgtaggagccaggcaacaataaatagcgctgaaatatccccagctgattccagtgtacagccaagtttaggaaccgtgtcctggtgtttccctcctactcttgctaatatgtagctctacatatctgtgtggagtgagactggcagaaaggctgtctggatgctccttcctgtatagcttggaggcaaatggactctatacagctcaggg

SEQ ID NO: 4947 - DNA, 931 bp, Homo sapiens
  misc_feature (930)..(930): n equals a,t,g, or c
gaattcggcacgagaaccagatgtttttccacacagaatgctagttctttaagacacaggctgggtgacatgtttccttagagtgacaatatttccttatagtgacattttccttgactggctccatgcagaataggaggatatagaataggaggagaaggtttctgctgtggcacctggagtggtacttggtgcacgccaggtgctagacaatgtgtgtgacaaggatgcacgtgaaatgcccccccccgagtgcctcagtgactgcagtaaagtggcccttgtcatggtcctcttcctctttctgcatcagtcttcatgctgggcggcatgaagagagaaacaaaaaccacctttcttgccagggtcttagtaccatttgctgctcttatctttcaagtaagggagaacatctaagaaacttatcaccgtattcattctagactgttagggrtttaactcttcacctacttccctgagtggtctgggctggargttcagagctaartgggctgggtgtaaatcaggattccgtccctcamtagctgtgaggctgtgggtaattcacttcatctctctgagccttcattttctcacctgaaaattgggcatgctaatacttttccatctccttcccagggttcacaggattaaatgaaattattaacacaaagttcttggcctggtagggggcatgtacgtggccaccgtcctggtgctggacactggggtaagagtttggaagctattggctgggcaaggtggctcacgcctgtaatcctagcactttgggaggctgaggcaggtggatcacgaggtcaggagattgagaccatcttggctaacacggtgaaacaccgtctctactaaaaatacaaaaaaaaatttagctgggcgtggtggcatgcgcctgtagtcccatctactcgna

SEQ ID NO: 4948 - DNA, 1166 bp, Homo sapiens
gagacctgcccatcgaatggaattgagcttcgtcaggcgcctacttctctttacattcttcttctccacattcagcccacccccacccaccccatgcttggaaggtcttatgtcctgcctgccttctccaytaayyaagaacacggcgggctcccaaaccaaatccctaagggagataggaacgggaatatcagacactcacgtatcaccttcccctgctcaagctccactttgcagccggagtcccacctgggattcatcagatccaaactccatggactagttaggcctggaaaagaccttagaggtaggaggtctttacagcttagcaaacattctttgagtacctgctatatgttgaggtgggagacttataaacaagtaagttacactgcagtgtgaaaatgacagtgtagatgataaagctgaagcttaagcgatgctgacacatagacttctgttagctctagggctttttcctgccttaactgacagactttgacaaatcttctaggactgtgtgaggaatgaatatagatgatcgaaaggggaattcttttaagacttgtgaaagaagctacattggagaactgaccttcccatgtactgaggacggcctgtgtgtgtgtatgtgtgcacatgggcatgtgcacacatgtgtgtaggaacctgtgtacatttcttttatcattctcctgatgcctttgttagtgtttctggctccctgcctgttcttaataaaatccacagtttatcttgtagcttracctttcttgaggccatgctacatttcaattttggtataatagaaagatgttgtcaaagctgatgggggctaggtcctaagctcattgaagactggaggctgtgccttgttttcctctacatcccctaagccttttgtacagtgtgtggcacctagagggtgcttactgtcagcactgaattgcgcccagtgcccaccagggacctgcacctctcatcaggaatgactttgggattgccagctgttctatctgctcctctcagcatgaacactaagcagagtgccttgtttttactgcacttgggagccatatcctgttgcctttttggatgattcgggggaaattccttgtctgtggttccgtatgtgttgcaggctgagggttggcttgctccctcga

SEQ ID NO: 4949 - DNA, 1566 bp, Homo sapiens
  misc_feature (415)..(415): n equals a,t,g, or c
  misc_feature (718)..(718): n equals a,t,g, or c
  misc_feature (1116)..(1116): n equals a,t,g, or c
  misc_feature (1122)..(1122): n equals a,t,g, or c
  misc_feature (1127)..(1127): n equals a,t,g, or c
  misc_feature (1312)..(1312): n equals a,t,g, or c
  misc_feature (1373)..(1373): n equals a,t,g, or c
  misc_feature (1455)..(1456): n equals a,t,g, or c
  misc_feature (1540)..(1540): n equals a,t,g, or c
ggcacgagactatcctcaaggagcttacatatcagtaaataaattattaaaggtggaaaatgtggtaaaagagacataatgtctcggagagagaacaaatttctgctttaggagtgttcttagttaaggtaacattagcttctataatacgcacactcccaaatctcagtatttcaacatgagtttctctcttgctcatgtaaagactggtcagggacccaggttgacagaggctcttcagtacatagcttccaagattgctgtgggtgtgacatccagccagaaatctggtgaagagagagcaatgattacacaggaacttttaatggaccaggcctgggacagcgtatgtcacttccaccaacatcccactcaccagaatttggtcacagggccatagctatctgcagagaangctgggaaatggaacttagctatgtgctcaagaggaaaagtaaaacagttattgaataattagtaataattagcaagtaactacctaggggtcacagaggacctctcaggtagaatttagacttaaagatgatgggggagtgtgtggaagatgggtgcagaatagggaaaggggggattgaaggaagaacaagctctagcttcacctgcatgggtagagcccacagtgttggtagggacatgttagctttcaacatcagcttcttaacagtattattctttcatcggaggaaattagtctatntctgaggaaaaaaaaatctgcaatacgtagcaatttacttacttggatattgaatgttaaagcagagagagactttgtcctcaaaaccctcccatttcagaagtgaggagcctggggaggtcatgctctctggatgtcacacagtgagtcactgtcaaagccagaatagaacccagacctctcagtttcccattccagtgctctttctatgaggaaagtataagtttgagcatttttaaaccttaattatgtagaaataaccatgatattttatcgtaaattatttcagtcatctcattttaaattttactccaaactaaaggaaaacggtactgatttaaaacatctatcataattcaatatagcccatatttcttctttaggaaaaattttttttngttttntatcntgaagacccgtgccctcttcctgtgtctcatgtagacatttcacagtccaaatatacagagcaagaatagatgaaatcaacatgtttaccattattctatctaaattttcaaagaaaaagggaacaaaaggtgagtgatgactgagttgcatggctataattgagtttttgttgcttttattttnataatattttaattgacatagatgcttaaatgtatatcaaaatgcatgtcacagctcttgnacaaagataaatttgactctagagcacattttctttagtgagaatgataaattatctcagagcttgtgattctctacttttnnaaatcataaggtcagttctttaattaaaagataaagaaaagtaggcattgtccatgtagtgaaatcacttttatcaggataatntagtaaccaaaaaaaaaaaaaaaaaa

SEQ ID NO: 4950 - DNA, 844 bp, Homo sapiens
ggcacgaggggatgacctttcttttctcccagcactggaagatgtgtggggcttccttcttccttctggcctcctgggtttctaaaagtgccacggtcattcactgcggcatctgttgtcagtaccaggccaccgccktctgactgctgacagaggatggctgccaagggctttttctttgcccccagttctcagcatttggttgcatgcatctgcacgtgtctgtgagccttatttggggtttgcttagcttcttaagtctgcaggtttgtgtctttgtgggaagttctcagccattattgctgcaatgtgtttctggccccgccccctttctcctctccctaggagtcagacatcagcctttttgggactgtcctacaggccctagcagggaggagacgcgcctcaatcccagagccctcacacgacccaggcagacttgctggtcttttgggtggcaagtggccctgaggccctctgagaagtctccatgtttctcttagtttgagtggatttctgtcccttggtttgaaaggattcctggaaaggcattacatgcaattaattcacacacatctactaccaccatgatgccagctccagatgagaaggaccaagaggcaaatctgggtggcctaggccctccaaggggacataggtctgcccaacaccacatcctacactcctccaaggaccccttttccaaaccaacccagtaccacagaacatgcaggagcagagcctctgggaagggtgccaggccccgtctgcccaggagcagaggcgctgagccagcacttggccacaggtggctccagagccacagtggacacaaggctctcga

SEQ ID NO: 4951 - DNA, 794 bp, Homo sapiens
  misc_feature (775)..(775): n equals a,t,g, or c
  misc_feature (794)..(794): n equals a,t,g, or c
gggccgtaaaaawcccttaattgttkamctgccttggcctcccaaagtgctgggattagaggtgtgagccaccgtgycyggcatacatggtcttctttcagattcagtccttgctgtccttcctggcttcatcactcagcatcatcttcctcctcccacgctgcctgattcccccagccaacggcactgcagggagcagctgcagtgaattccagaccttgcacactttccatccccaggcctcctgtgctcacgctggtccctctaacctgtacacttttctcsgcctctttgatttgtctgccaaggtctcacctttgatgtgaagtcctttgccaagtcttctctaacttcccttgagttaggtgctggtatcccttagggaaatttttgactactcataacagagaagtgacaactgtggcttaacaagacagaaactgaatttctcatgttaaatgaatgtggaaacagagtccagcgtggtacgacagcttgacagtcatgacagkcctggctccttttcttcttctttcatatctgggcaccgacctcctccttcttcttctccttctccttccttcttccttcttcttcttttttaaaattttatttatttattttaaagaatacagaggctgggcgcggtggctcatgcttgtaatcccagcactttgggaggctgaggtgggtggatcacctgaggtcatctgtactaaaaatacaggcgcctgtaatcccagctacttgggaggctgaggcaggacaatcgctngaacccaggaggcggaggn

SEQ ID NO: 4952 - DNA, 811 bp, Homo sapiens
aatcaaattcctctgtcaatgaccttcaatgctatctctaagaaattcctccaggagtctgtctgtcccatgctagaagcctcagaactgtgcctctgtgttttkatcctggacacaatctgcctagaaggtcttccccaaactcgtgtcagctgaattcatacctggtatctctctcccccagcttagtgtaaacttagtgcagggactttatcttgcctcaccaatgtcttcgccacccaagaataatgcttggcacacaagagggggccaatacatttttatgaaatgaatgtagacttaggatatgtgtctgttttttgatatgtttcctgagtggtcagtgttcttccccaggattccctgactccaaaccagccctctgttagggacaaactgcccaagaaaccttcttggtgctgtccacccatcccccaagcctctttacatttctaagcccttacctaggcaccacggtgaagccagcagactttgcttatcagaccttgctgcaataagcaaaccccaattacaaaccacccacactgcacagggggaggtcatgggaaacataaacaaactttacctacaccctcctgtaataaacgtcacaaggtaatatgtagcaaaattaaccagcaaacaaccccaggatgcggccatacgaaagaactccatcaaactcccctccccaatataaacccctcattctgtaagcttggggctacttcctctctgactgttaagggagcagccagcaggttaataaaaagttacctgcctaaaaaaaaaaaaaaaaaaaactcgaggg

SEQ ID NO: 4953 - DNA, 707 bp, Homo sapiens
  misc_feature (6)..(6): n equals a,t,g, or c
  misc_feature (47)..(47): n equals a,t,g, or c
  misc_feature (56)..(56): n equals a,t,g, or c
  misc_feature (527)..(527): n equals a,t,g, or c
  misc_feature (649)..(649): n equals a,t,g, or c
  misc_feature (695)..(695): n equals a,t,g, or c
  misc_feature (707)..(707): n equals a,t,g, or c
taaagnacagcgagagtctcaccatgttgcccaggctggtcttaaanttcctgacnctcaggtgatctgcccacctcggccttcccaaagtgttgggattataggcctgagccaccgtgcccggcccaagcacagacttctgttctgtgtgtcacctcatggtccaggctgactgtatccactctcacctccacatcacaggcagagggagttagagcccttcccatatggccatcatcccaagtctgcagcatccagccataactagactcctcctcccaactggctctagaagaggctagcagccttcaatgttamcccaaataagtcagggttcccttgtgatgaccctaatgttcactatcttggcatcctaccttctttatcctggcatttatcctctttccccagagttaccttcttacccctctaagagcaagtcagtacaaagattggcttgtcatgtttccttgttgactgttgtatccctgcacctaacacagtagcttgaacacagcaggtactcnatactggaaaaggaaagggtagctgtttggccttcaagttaggaacagaggcaacacaacaggttagatcaagcacatctcttttttttttcttgaggcaaagaaaaaacaggcaaggtctngctctgttgcccaggctagagtgcagtggcatgatctcagctcatngcagcatcaacn

SEQ ID NO: 4954 - DNA, 685 bp, Homo sapiens
  misc_feature (303)..(303): n equals a,t,g, or c
cggcacgagcggcacgagcccacagcctgcaggaccgaggcccctgtgtgagggactgggggtgtgaggagttgccaggagaagcagaccctgccaggtgcccatctcctctcagcacccctccccccaacacacttcctgtaatggcgtctccaatggggagcccattagtcctgcttagggcagcacctaagtactgtggctgataaatataacatgagcccatcgattagaatcctcctagtcctacagcagctcggctccctaatggctcccctcccctcagcacactgaytacccacntctcaccccccamcccaggctgattttctggtttacttgaggctgtggggcaaacatgagaggagcagaagtgaggtgatgggtgcaacacccagagcccagtcaaaggggccactgcttggagacaggctggactggtytgggccctgaggcagcctggaagcccctcggtcagttaggggcagctaggggaggaccgcctgtgagttcccggggcccggcctgcggtargacatggarcaaggaargcagarggccctactttytgtgrrgcscaagacakcactgcccttgggggccttgggggtctcctggtaatctcaaaaaaactgcaatgatccactctggcctgttaccacgcctcttctcctgggattccttg

SEQ ID NO: 4955 - DNA, 535 bp, Homo sapiens
  misc_feature (517)..(517): n equals a,t,g, or c
  misc_feature (528)..(528): n equals a,t,g, or c
  misc_feature (532)..(532): n equals a,t,g, or c
ttaagctggagctccaccgcggtggcggccgctctagaactagtggatcccccgggctgcaggaattcggcacgagagaagattttccaggcaaaacccagatctgctttagtgacttcagaagaaaaagatctgagggaggatgagaagccgatagccaatggtatgtgtgtgaaaacacgtggcagacacacatgctctccagcattctatctcagctgatggtcagcaagccttggggcgtcttcatctccttctccttcatctcactgtctttctaccatgccatctctatcagttcagttcccagtggaagacaggtggtttagccaaagaaaatctaatgaggggtctatttatctgtggtcagggtttgggatgcccatgtgcagtartgatgccccagggatgaacaagatgggaagctgtggccaccttgagactcaggccaacagaarggactatgcttctggagccctggggaagcgggaacttggaaaaaggccagaagggtcancttaaaaactnttgnccc

SEQ ID NO: 4956 - DNA, 801 bp, Homo sapiens
  misc_feature (1)..(1): n equals a,t,g, or c
  misc_feature (63)..(63): n equals a,t,g, or c
  misc_feature (140)..(141): n equals a,t,g, or c
  misc_feature (154)..(154): n equals a,t,g, or c
  misc_feature (157)..(157): n equals a,t,g, or c
ngggaatgcccccatgtgcagttagtgatgccccccccccccaaaaaggggggggattgagcnagagttgggaaagctgtggcccacctttgagaccttcagggccaacagaaggactatgcttctggagcccctggggnngccgggggggggnaanaggcccttttggaagagggcaagaggggtcacctcagaagctatagtcacagggagatgcaaccactgcccagactgtggcaaggcatggcgggagcagggggaatcaacacccagcacctgtccctttgaccctttgacttgctggtggcttgcattggctaaaccagaaactggagggcaagagcccctcagtgtagcagcctatgggggccaaccttctgaggtcaaagcaggacagaaggtggagaagggacttggggggacacatggagaacaatcaacaaagtttaccccctttgtcayttggcactggaaaatctgagaagcaccagatgttgtgagttacctaagaggggtttgttgcttcaatgtctttccaatttgggggatttttgaagaaagtgtttatgagcagggcagcttgcccctttacctagtcttccaagaataaaagacaaggcctcagtttttagtcagttgtaaacacttatattctttatttttaggttatgaggatgagggtcgctatccaaaggattgagagagtaggcttttgcactatgtagccatggattcaaatcccagcattaccattgattagcttggggcttttataaagttagttacctctcttagtctcga

SEQ ID NO: 4957 - DNA, 470 bp, Homo sapiens
  misc_feature (36)..(36): n equals a,t,g, or c
  misc_feature (39)..(39): n equals a,t,g, or c
  misc_feature (108)..(108): n equals a,t,g, or c
gcttccggcttcgtaatgttgtgtggaatttttgancgnataccattttcccccaggaaacagctatgacccatgattaccccaagctcgaaattacccttcactaangggaacaaaactggagctccacgccggtggcggccgctctagaactagtggatcccccgggctgcaggaattcggcacgagacagaatgctgttgccaaaacctgcacagccctgaggccagcctcggccttggtaacgggggaaagtagctgacagtgagacggggctcctggcccacgtgtggggcacgggcatcctggatggttggggaggcgccgacaggcacttcacgtattacaattggggatgtgggtgagggagggaatctggttttgttacttggcagtggttttttctcacccttcctttttaacaataaaatcccatttgggtcttgaaaaaaaaaaaaaaaaaactcgag

SEQ ID NO: 4958 - DNA, 744 bp, Homo sapiens
  misc_feature (303)..(303): n equals a,t,g, or c
  misc_feature (392)..(392): n equals a,t,g, or c
gaattcggcacgagagtggctggagtctggctgcagagggaagacatcagcagggagggagccagggcctgtcacatctttcctctggccattgtcctggtctttgtaagcccagaatctccccttccctgaagggaggccagcaccccaggagggcagcaggtgtgctgtgagggttggagtagtgtgagaggtcagggtacactagaatggccatggacaccatgtgggggtgctctgggctgggccacagaacagtgtccttcctgctgctcctcccctgcagcttcccccgaccttgtngtttatttggtttgataccaatcagcagaccctgcaaggtggaagctcccaggctctcagtcccacsactctcatgtgccagtcacccntactgtaactgcccaatgagtacttcttgcccactgccaagatagagccagtttaccaagacaggggaattgcagtagagaaagagttgaatatacatagagccagctaaatgggagagtggagttttcttattacttaaatcagcctcccytaaaattcagaggtgagaatttttcaaggacagtttggtggscaggcctagggaatggatgctgctgattggctagggatgcaatcataggggtgtagaaaagtwccttgtgcactgagtccacttttggtgagagctaccaaggagctgctggtctgctggtcccggtagagccatctggtgtcaggaatgcaaaagtg

SEQ ID NO: 4959 - DNA, 592 bp, Homo sapiens
ggcacgagattttgtagtgatgggggtcttgctatgttgcccaggctggtctcaaactccagcctcaagccttcctcctgcctcggccataagtcttttttaatcacagaaatatttcaaacacgtgtaaagctctctttaatggagctcgtgtttctcatcatctctctggtttgccaacattgcagtcctgacagtgctggggatctgtgtgtccaaacaccctctgtttggccgaggaccctgatggaaataatgctctccagccttggtgaatttgcactttcaaacaaccagagatttgtctgttttaataacattcactctagctgggcgtggtggctcacatctgtaatcccagcactttgggaggctgacacaggaggattgcttgaggccaggagtttgagaccagcctaggcaacacagacaaattagccaggtgtggtggcacgtgcctgtagtccagctactcaggaggctgaggtgggaggatcacttgagcctgggaggtcgaggctacagtgagctattatcatgctactgcactccagcctgggcaatggagtaagaccctatctccaaaaaaaaa

SEQ ID NO: 4960 - DNA, 718 bp, Homo sapiens
ggcacgagctcagccacgtgaccaaccgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaaggtgctccatcgattcctccgargcgggtkggggctgctcggttcctggacggggttggagtaggcaaagcaaggcactagtaggaagggaagtaaaggttataaccacaccccaaatcgagcacctgctgttcccgtatgaggagttccttctccgtgcctcaccggaagactccatttmattgaccattagggagtttggtttgagggttattgttacttctttaccccctatttctttctccctccaacctgttctcttaatgaggatctcataattttaaggcaatcaaattatggtttaaatcaccatttcctctcttattaacggaataaattaggatcctgggtctcagtatcttcaccagggttgttgtatacttatctgtagtctcctc

SEQ ID NO: 4961 - DNA, 2150 bp, Homo sapiens
ggcacgagcaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcgccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaagggatggacagcatgacctctgggtgtctctccaactcaccagttctaaaaagggtatcagattctattgtgacttcatagtgagaatttatgatagattattttttagctattttttccatgtgtgaaccttgagtgatactaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggtatgctgcagttcagccgttgaacacataggaatgtctgtggggtgactctactgtgctttatcttttaacattaagtgcctttggttcagaggggcagtcataagctctgtttccccctctccccaaagccttcagcgaacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgctaaatcaaaaaaaaaaaaaaaaaa

SEQ ID NO: 4962 - DNA, 535 bp, Homo sapiens
ggcacgagtccagatcccactgctgcccactgtatttttgacacaagtcaaatcagtttggctgtattgtttgctgctcactatcaccgtattaaagatttgtgaggggcactgctactgctgctgcacttcagggtatgaatccattcaatgtttgctttctcacctctatctaggctggcaatgttaggtgtttgttgtggttgttgtttgggtttatttttagaaagtgatacaggaattaatttcctaaatttcaattaccttgcttcctacagttggtcctccaggtccagtaatttcaacaatctgggtattttttcttttttcttttttgagacggagtctcgctctgttgcccaggctggagtgcagtggcactatctcagctcactgcaagctctgcctcctgggttcacaccattctcctgcctcagcctcccgagtagctaggactacaggcgcccaccaccatgcccggctaatttttgtatttttagtagagacagggtttcaccatattggtcaggctggt

SEQ ID NO: 4963 - DNA, 1681 bp, Homo sapiens
  misc_feature (6)..(6): n equals a,t,g, or c
  misc_feature (50)..(50): n equals a,t,g, or c
gaactnattgaaaactggaacacactactataattaaaagaatggcaganaaaagtaaatatgatgasctttaagctggatcctctaacttagaggaagactatgtattataaaattagctaaataagagccacaattattaaagtgaaaatcaaaactgtttcaaggtacattatcgtgtttaaatttgatctgggtctttcttttgactgtggccatggcactactaacctaaagaaccttcaggctcccttcacggtagatgtcctttccttcgtccctgccatacctggaacatgctcctcctcctatcactctcaagtcctccccacccttcaagacccagcttaaatccctacttcttgactgaagcttttcctgactcttccaccctgagtcattttcctctccttcaggcactcttaacacatcaattatgagtatctctttacatacctgacctccctccttccccctcaactcaaagctcccacagagcagggacctggtctttctatgccaagtgcaaattaggctcttggtacttgaacaagcaaacaaaaactatttctataaatagaagaaatacgggacaaatacagattcattcttttttttttagacagtctcgctctgttgcccaggctgaagggcagtggcacaatctccacactgcaacctccacctcccgggttccagctattctctcacctcagcctcccaagtagcagggattacaggtgtgcactaccataccaagctaattttttgtatttttagtagagacggggtttcaccatgttggccaggctggtctttaactcctgacctcaagtgatctgcctgcctcggcctcccatggtgctgagattacaggcgtgagccactgcatccgaccaagattcattcctttttttsttttagacagagtctagctttgtccccccaggccggagggcactggtgcaatcttggctcactgcaacctctgtctcccaggttcaagtgattctcccgcctcagcctcccaagtagctgggamtacagggcatgcgccaccatgcctggctattttttgtatttttagtagagatggggtttccccacgttgcccaggctggtcttgcacttctggcctcacacgatccacgcgtcctggcctcccaaagtactgggattataggcgtgagccaccgagcccgcccagattcattttttactacaaaattcctaacaaagaacaaaaatgtataggagggatattactgcaatttagagtaccaaataagaagggatatagcagggaaaatgattaaatattagtgtaaaatgtgctcaatacaaaagttttccagcttttgttgcagagagtaagtacaggggttgagtccagttagtttaaacgggcaggaactgttcactgtcaacccagaacaggttgacagtggcacataacgggttcatgtcacacccctgccaaggcagaagcctatcatgtgatttataaagcttggggacctttaagctttgataaaaacgctgtaccaccaaagaactgttaaggaagcaatggcttcatctcaagagtagacagattacactttcaaaacactgacggggccgggcgtggtggctcacgcctgtaatcccagcactttgggaggccaagtcgggtggacca

SEQ ID NO: 4964 - DNA, 481 bp, Homo sapiens
ggcacgagtctgtctgaatccaagatccgtgccatgctctctgcccctccttcctgcccctgaccactaatggcaggcgccaacagtccagccatggggggagtttggcatgatcaatgaaggcaaagaggaacaaggggagatgggtggcagcagggccaacggcagctactgcatggattgttctaacagtgcaagctgcctgccctgaaggtaaatgcccactgcctggagtctgtgccccgatcacctgggcccccagttatctaacagctggaaaggcgaagctggctgggccgaggacttacaagcctgggccagtgctaaaggcagcacaccttcccatggggcagcatccacacaccaccccctggtggcagcctttgttcatcatctctgtgagcagataccctccccgcactccaaagcagcactaatatctgcacctcttctgttccaagggtttctttctccttctcga

SEQ ID NO: 4965 - DNA, 452 bp, Homo sapiens
  misc_feature (4)..(4): n equals a,t,g, or c
  misc_feature (43)..(43): n equals a,t,g, or c
  misc_feature (273)..(273): n equals a,t,g, or c
  misc_feature (276)..(276): n equals a,t,g, or c
tgcnatgctctctgcccctccttcctgcccctgaccactaatngcaggcgccaacagtccagccatggggggagtttggcatgatcaatgaaggcaaagaggaacaaggggagatgggtggcagcagggccaacggcagctactgcatggattgttctaacagtgcaagctgcctgccctgaaggtaaatgcccactgcctggagtctgtgccccgatcacctgggcccccagttatctaacagctggaaaggcgaagctggctgggccgagnaantacaagcctgggccagtgctaaaggcagcacaccttcccatggggcagcatcsacacaccaccccctggtggcagcctttgttcatcatctctgtgagcagataccctccccgcactccaaagcagcactaatatctgcacctcttctgttccaagggtttctttctccttctcga

SEQ ID NO: 4966 - DNA, 931 bp, Homo sapiens
  misc_feature (717)..(718): n equals a,t,g, or c
ggagtaatgaggctgaggaccagacaaaagagcagaaggcagaggaaagaaaaaatgagcaggagaaagagcaagaggaaaatgaagagaaagaggaggagaagacagagagccaggggtcaaagccagcctatgagactcagcttccatcccttccctaccttagtgttctttcaggtgctgacccagagctgggttctcagctccaggaggcagctgcttgtggtgagagctggtccccacccaccctggcccctttttgacttgccccattctgtgaccccacaggcctcccacacctcagtctaacttcagttcccatccttcatcccaggcactaactatattgaagcgtcttgtgggaaccctcctatcagccacagggaagctggtcagagccagamctcgtgcctggggaatggggatatgggtgctggcattgtgggtagggtgcctttgcttcctctacaggcctgcctgtggtactgaccaatgtggagcttggtctaaggtgcgaagaactgcaatggctgytgcaacgggagcagctkagtccaccccargtgcarcctggcttctgtctgtatctcacaccaccctytycctctgkgccatggaaaaaggtgaggcccagagggcaaattgccagcacagttgtgtggacacactaggccctcagcaccagccctaagagggcttcactcaacctggcccagnncaggcacaggtctatagcagggagccatactccctgtctactctaccccctggctctgccaaggggaagaggttaagcatctcccatgttaccccaagtgctaggttgtgaactgctaaaggggctgaatgtgttggatctgggcctgaacatggaaatactggaagaacagatgctgcatgaaatcttgtgcagagagtatcctgaactcga

SEQ ID NO: 4967 - DNA, 883 bp, Homo sapiens
  misc_feature (12)..(12): n equals a,t,g, or c
  misc_feature (19)..(19): n equals a,t,g, or c
  misc_feature (25)..(25): n equals a,t,g, or c
  misc_feature (812)..(812): n equals a,t,g, or c
  misc_feature (877)..(877): n equals a,t,g, or c
aagcgctgcacnctgtctntttccnggcttccttgctgtgcatgtctgcctgttttctggatggttggtagygctatgtggggtctgatgctgagatcatcgkcactctgtttgacctagactctatgtggatggggttatggtgctgcaggccatcatgtgatcatggtagaatgatggcgggttctcagggatgaagagagtcagttgctactggtccccagggcaggatgcacactagtagtgagtctagcttcaacttggtgccatgctacagcagcttaggacaaggtgggctcccactctgaggcagtacagctgaatgatctcttggctactctccagactggatttgtggccactgaggacttaaggactctcctttatcaagaattgctggtgcctgtggcagcagtggggaccactgataggtatctctagcttaytttttccctgtaagaatttcctctgattttaagctgattttggcaagggagacagtgtggcaggtaggaaacctcactcccttccctgtggtgctatcctgaggcttccatgctccacagggattttgccctttctctggtgctctgcagcatatatctacagtcattttagttgaaatatagytatttgktattttggtccctttttgktgtgggtgatatgtgccaggtaactctggtgagccatttttttttaaacaaatcttcatacagawtgagtatcccctatccaaaatgcttgagaccagaagtgttttggawtttgktttgttttgttttgcttttggattttggaatagtaataantgtattatacttatttgttgggcatcccaaatcctgaaagatgggcccttgaacagagtgtgagngaagcc

SEQ ID NO: 4968 - DNA, 765 bp, Homo sapiens
taacctctggtgrgcccatttttttttaaacmaatcttccatmcagattgagtatccccccctatccaaaatgctggagacccccaagggaaaaggttggttttttggggaattttttttttgggtttttttgttttttttgggttttgcttttggattttggaatagtttatttgtattatacttatttgttgggcatcccaaatctgaaatatgctccaaaatccaaaatgtgaagtgctccagtgaacatttcctttgagcatcatgttggtactcaaaaagttttggattttggagcattttggatttcagatttttggaattgggatgttgaacctgtataatctttaaatcatctgttcagcaaatcgacaaacatcgaggacagtttctgtcttcaacgaagttgatagtcaggtagctagggatagctaatcagtgaataataatacctggtactggtaggaaagagcaccaaccacaaccacagaaggcttcttggaggagctgatctctgaactgagttttgaaggatgagtaactaggtagcgatgcagagaaagagaaaatatgagcagggatataaaagcagtacattatcatgcatagcaatatactaagctgcaatatcatactaaactacaagcagtttagtgctttctagttgcgggggtaatgttcaatataggggatctgtaacgaggtaagttggagaggaaaacagaagccaggttctgcagcaacttagctttgtagcctcga

SEQ ID NO: 4969 - DNA, 1016 bp, Homo sapiens
aaagggaacaaaagctggagctccaccgcggtggcggccgctctagaactagtggatcccccgggctgcaggaattcggcacgagcagagacccccaccccccagctgtcctgatgccccaagccaaaacataattcctggcagctcccccactccccctccccctcactcttctgccacccagagcttggcccgcctccaacagcccatgttctaattctgcagtttccagaagcccaccctcaaacccaggtcacttccccagcccctccagcttctagtccccgggtcgtgcccatcctcaccttcctgggctgaaacaccacattaggcacccagatgcctctgcatctgaaaatctcacaagcctggatgtccctgacgccacccactccggttctctttctctttctcagcctcctgtgggctcggttttttctgtccaggcttaaatgcccaggtggctgtctctgctggcccttacttctctcacggggatcctcagcggcaccctgggcttcagtccccatggatggagcagcccacgccgccatctcagccccaggcctgagtgtccagctgcttcccagacaacttgcaagtccctcggccaacactgagctcagagtcctcctcctccctgccagggtgcgccactaccttccctccagttttcaccaggtcttgggttcatcctgactccctccttcttctctccccgtccctgccacacctcactgctcacaagaaagacatcactgtgtccgttctccttttttcttttcttttcttttttttttttttttttgagacagggtttcgctctgtcttccaggctggagtacagtggtgcgatcttggctcactgcctcccaggttcaaaaaattctcatgcctcagccttccaagtagctgggactacaggcacgcgctaccacacccagttacatttttttgtgtatttttagtagagatggcttttgccatgttggccatggctggtctcaaactcctgg

SEQ ID NO: 4970 - DNA, 245 bp, Homo sapiens
ttcttttcttttcttttttttttttttttttgagacagggtttcgctctgtcttccaggctggagtacagtggtgcgatcttggctmactgcctcccaggttcaaaaaattctcatgcctcagccttccaagtagctgggactacaggcacgcgctaccacacccagttacatttttttgtgtatttttagtagagatggcttttgccatgttggccatggctggtctcaaactcctggcctcga

SEQ ID NO: 4971 - DNA, 722 bp, Homo sapiens
gcagagacccccaccccccagctgtcctgatgccccaagccaaaacataattcctggcagctcccccactccccctccccctcactcttctgccacccagagcttggcccgcctccaacagcccatgttctaattctgcagtttccagaagcccaccctcaaacccaggtcacttccccagcccctccagcttctagtccccgggtcgtgcccatcctcaccttcctgggctgaaacaccacattaggcacccagatgcctctgcatctgaaaatctcacaagcctggatgtccctgacgccacccactccggttctctttctctttctcagcctcctgtgggctcggttttttctgtccaggcttaaatgcccaggtggctgtctctgctggcccttacttctctcacggggatcctcagcggcaccctgggcttcagtccccatggatggagcagcccacgccgccatctcagccccaggcctgagtgtccagctgcttcccagacaacttgcaagtccctcggccaacactgagctcagagtcctcctcctccctgccagggtgcgccactaccttccctccagttttcaccaggtcttgggttcatcctgactccctccttcttctctccccgtccctgccacacctcactgctcacaagaaagacatcactgtgtccgttctccttttttcttttcttttctttttttttttttttt

SEQ ID NO: 4972 - DNA, 2502 bp, Homo sapiens
ggcacgagagagcctggggccagagggccagacagccacagagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagaggttccgaggcaggtgatgaaggacgaggacaagccccctgacagagtgcgacttcccaagagcctttttcgatccctgccaggcaacaggtctgtggtccgcttggccgtcaccattctggacattggtccagggactctcttcaagggcccccggctcggcctgggagatggcagcggcgtgttgaacaatcgcctggtgggtttgagtgtgggacaaatgcatgtcaccaagctggctgagcctctggagatcgtcttctctcaccagcgaccgccccctaacatgaccctcacctgtgtattctgggatgtgactaaagggaccgtgtgctcctgagacccaccttggaccagtccacggtgcatatcctcacacgcatctcccaggcgggctgtggggtctccatgatcttcctggccttcaccattattctttatgcctttctgaggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaagcccagagaggcatcacagtctgactgtgagagaaacagccaagacaggagtgacgagactcaacctgttcagggaagtcactagaaacccaggcgtcctagatgcagcgggtataagcccccaagaccaggactggctcccagcgccccatgagagatgtgtggcttagtggctagggccaggcagccctgggtccaaatcctagccccatccctgacccagcaagtcactcagctccttccgtcctcattcatcgcgaaattgggataatcccgtacttatctcaccagctttttttttttttttaattgagatggagtcttgctctgtcacccaggctggagtgcagtggcacgatctcagctcactgcgacctccacctcctgggttcaagtaattcttctggtttcagcctcctgagtagctggaactacaggcacatgccaccatgcccagctaatttttgaatttttagtagaaatggggtttcaccatactggtcaggctggtctcaaactcctgacctcagatgatctacctgcctcagcctccgaaagtgctgggattacaggcgtgagccactgtgcctggcctgccagatttcacaatgaacaatgacaatgcatatgtgggaactactaggtcttcaatatgtgggaactatattaataatcatagaaattatgactgtaaggccatctgaggctgtctccaggtggagaatcatgagtccatgcctggagaatcccaggggttgatggttggggagaaatgaactttgaaactatagctgacatcgttattctttcagaggttaccttaatatgtaagcctgcacacttcactctactaagtttccactgggtctgagttattctgtatttctctcttcctctccaatacaacagagcccttggtatacttgaattgcccattgaactcttctcaatatttgtcttgcatatagaggtttagttacagatttccttgaaacatagagtttttctaagtcatgttctgtacttactataatttctttcaccccacactttcccttttcctcttgctggagtgcctcccataataatcctttatagagggagtgatggttgttttgtatgtctgaaaattcctctattttgctctttcttttctgtaataggcataggtagatattttatttgaaggtctctgtttttcatttccaagatttcgatttggttcttttttatttcatttttgaaatggttgtgaaatggttgcatttttgcctttcccagcagttcttgagtggttacggtgggtctcctccctctcagcagccaccagcccaggctgccccactctctgcccacccctttccaggctcaccgaggcctctccttcctaacaggtg

SEQ ID NO: 4973 - DNA, 838 bp, Homo sapiens
tgccccatcgtttttytytsaccagcgtacgcccctaacatgaccctcacctgtgtattctgggatgtgactaaagggaccgtgtgctcctgagacccaccttggaccagtccacggtgcatatcctcacacgcatctcccaggcgggctgtggggtctccatgatcttcctggccttcaccattattctttatgcctttctgaggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtmccgtgctacagcggtcaaggagcgggggaagaaccggaagaaggtgctcaccctgctgggcctctcgagcctggtgggtgtgacatgggggttggccatcttcaccccgttgggcctytccaccgkctacatctttgcacttttcaactccttgcaagcccagagaggcatcacagtctgactgtgagagaaacagccaagacaggagtgacgagactcaacctgttcagggaagtcactagaaacccaggcgtcctagatgcagcgggtataagcccccaagaccaggactggctcccagcgccccatgagagatgtgtggcttagtggctagggccaggcagccctgggtccaaatcctagccccatccctgacccagcaagtcactcagctccttccgtcctcattcatc

SEQ ID NO: 4974 - DNA, 753 bp, Homo sapiens
  misc_feature (2)..(2): n equals a,t,g, or c
  misc_feature (21)..(21): n equals a,t,g, or c
  misc_feature (71)..(71): n equals a,t,g, or c
  misc_feature (199)..(199): n equals a,t,g, or c
  misc_feature (259)..(259): n equals a,t,g, or c
  misc_feature (479)..(479): n equals a,t,g, or c
ancgaatcttggcttaactgnaaacctcccaccttccccaaggtttaaagtgatttcttctgccctcagcntcttgaagtagctaggattacattttaatgcgccaactacgcccggctaatttttgtatttttagtagagataggtttcaccctgttagccaggctggtcttgaactcctgacctcaagtgatctgcntgccttcggcctcccaaagtactggtattacaggcatgagccaccatgcctggcctcttnttaatctttctatatgctattctataacccatataggttttggtgccagattctcagaaatactggattttctgggtttttaggtttggaaatttgagatagagagtaaaggagctgtgaacacaagcgaggtggtctgggcttctgtgttgagtgatggggagcagtggggtctgtggcgagctgcagattgcagtattgtctggaggaggcagccatnagtaggcactggccagtttgcaagtggaaatgaggtttaacattcttgaatttggtttgtaaaagaaagccagggccgggcatgcggtgctcacgcctgtaatcccaagactctgagaggccaaggtgggcagatcacctgaggacaggagctcgagaccagcctggtcaacatggtgaaaccccatttctattaaaaataacaaaaatccggacgtggtggttcatgcktataatcccagcyacycgagggggggcccggacccaattcccct

SEQ ID NO: 4975 - DNA, 729 bp, Homo sapiens
  misc_feature (534)..(534): n equals a,t,g, or c
  misc_feature (547)..(547): n equals a,t,g, or c
  misc_feature (569)..(569): n equals a,t,g, or c
  misc_feature (571)..(571): n equals a,t,g, or c
  misc_feature (583)..(583): n equals a,t,g, or c
  misc_feature (672)..(672): n equals a,t,g, or c
  misc_feature (709)..(709): n equals a,t,g, or c
gtttctctctcgtctctgtgcgtccgcatgtctctctttgtatgtctctgtatctctgtgtgtctctacttatctctttgtctctgtctttaaatgtctctgtctcagtatctctaaggctttgtctctatttctctcctcctctctctgatgctatctctctgtgtctatcactgtctctctctgtctctccctttctgtctccctctctagcactctgyttcctctgtctctgcctctttctggcccagtccagagcccttggcatgaggacacgggtgagtcagggctggctgcaattggacacctcagggataccagccagtcctggtccctctaaaggggagcgatatgtgactttcggggtggtagggggtgcgggtagtaatctggcggtacattctgcccggccccttatagggaatttactctcagttggacccacctccacccttacccccaccagagggctgtcctggcaaagcatagcagcttcaccatcaagcacaggacatgccaagtttcgagagacgnttaagaattaagngcaaccaatgaataaggcaagnantacatgggacanttgactaagttatcttgatcactaaaaggctaaggtgggcacaagacaacctggacagacattactgggaagaacttggaaatttgganggcacttaacaatttgaaccaaggggaagcaattcanggttcacctgggcaatttaa

SEQ ID NO: 4976 - DNA, 338 bp, Homo sapiens
  misc_feature (23)..(23): n equals a,t,g, or c
  misc_feature (193)..(193): n equals a,t,g, or c
gctgttttcatagcagttgaggnccctgcgggactctattcctgagcagttctgcaaccggctaaaggctcctggcaatagaacacacatcagtggttgccttgggggaggccaggacttggggggacctgagagagttttctgggatgatggaatattctgtatcttgacggtgtggtgtttacacaggtgncaacatctgtcagaaatcaatgggttgagcctttaatatctaccttattgtatgtaaattctaattcaagaaaataaaataggctgccaattcagaaaaagaaagaaaaaagagggagcaggaggcataggatgtggcctgactt

SEQ ID NO: 4977 - DNA, 501 bp, Homo sapiens
  misc_feature (460)..(460): n equals a,t,g, or c
  misc_feature (466)..(466): n equals a,t,g, or c
  misc_feature (480)..(480): n equals a,t,g, or c
gggcctgtgccatccacccctgccacttttctggcgacgtccccattcccttttcccttgcacaatggcctcctggccattcctcagccccatgggcccaatcgccttagctctcctgacacaagccctctcatctsccgtaggtctctgtttagctctcacttgctcacggagaccctcccctgattccgtttgtgcatcatgcaggttcccccttgtccccctgtgctgccagccctccttacccgctctgcttagacctgtcagccactgtagataccctggaacttcctgggtatcatgktgaatggttwattgkctatttctccccatgagaatgtcggactgtgaggcagggacctttgtggtattcgttgccgtgacccaagcccctggaacgatgcctagcacataatcgcaggttctcaaatatttattgaaaggatgtttaaaagacaanggttgnttcacaaggatggntcgtggaccaagtgggcaagg

SEQ ID NO: 4978 - DNA, 657 bp, Homo sapiens
  misc_feature (15)..(15): n equals a,t,g, or c
  misc_feature (29)..(29): n equals a,t,g, or c
  misc_feature (75)..(75): n equals a,t,g, or c
acttcagcctaggtnacagtgaaactccntctcaaaaaaaaaaaaaaaaaaatggaatcctttatgtttcacttngttctcattagcaggactgtgcgaggctgagtcaggagaccgaggtccattctgcttgtgattttgctccgtgcaggaatgtggaggtgtggcccataagcatgtcattcatgcaaaatcatctacatgcattcaattagaaaaaaaaaggaawacagcagtgaccctcataagtagacttggttagtgtcaatgtagggagtgagtttcttgtgaccctgctgttcttcctgggtcccgtgacagggcatctggacaggctgaatgcgattctagaattagattcctatgtttttatatgtacgcccmagtctcacttgccagtggcttcctctgacgcttagaaaataaatggcatctgcaccacgtcagggagaaactgactgctttggaattcccagaagctcttggaagggaaccttcctgagggatattgaaggagaattaaagaattttctcaatggctggcacaacttatggagtcaatgctcattggctgtgattggctgagctgggatcacatgtgcatccttggaccaattgctgtggctcgagggggggcccgtaccccattcgccgaca

SEQ ID NO: 4979 - DNA, 542 bp, Homo sapiens
ggcacgagattgtgccactgcatgaggggcagagtgagaccctgtctcaaaacaaaaacaagaaaaaccaaatgctccttgatgtaccaaccccacacacagagctggttcccctggtgcttgatcctaagctcctcccaggcagggaccagaggactcagttggcacttagcaaacgcacctgtaaagccggggatgggtttggcttttgcgctgattagacttgattctctccttacttgttatctcccctgcctccatgtcaggctggtgagagctcacacatgcacctctccaacccgtccgcttctctcttatcagtctgtgcctgcagctagcatgatctgcccaccctgtgaaatcccccatggagaagggagtttcgaggtggcaggtcggtccacagaaatgtcacatctgcctgtggagataccccgtctgcctggacaatgtcaacagagtcagaaaacacacccccttgcatggagctgaggtgtgtcagggaaatcttgggaacccctccctcccctgaaagaacggca

SEQ ID NO: 4980 - DNA, 1190 bp, Homo sapiens
  misc_feature (1164)..(1164): n equals a,t,g, or c
  misc_feature (1180)..(1180): n equals a,t,g, or c
  misc_feature (1189)..(1189): n equals a,t,g, or c
ggcaccgggtctctttgtcccacatacatttggatgaatgcgtgcacacatactcttataccaggactcagggcccccaaccagggtatctggtcctcatggaacagtggaggcctcgtctctcccctcctgccccctactctcccccaccatctctcccctatcttgaagttgtgccaccctctgcttggcctacaggcccccatccaaaggtaaaagagctgggccatgtgcaaactctcatccttccaaactctcctcttgcctcctcctcctccaggcagtccacttggatatctatggttgggaggtgctcgatcctgtcttctacccctyagaggcatccctctctcagctgggagggtctgggaggttgacaaccaacaattggsaacaattaccatttatggagcacacactatgtgccaggcaccacattgaacctaagtacagcccaagagatagacactggtttttgcccatyytasaggccaggaaaatcctgtgcttcaggtcgcaagattagaacatgtagakctggagctcgaacccatttctgtckgasggsaaagcctagcccttgactccgctcccgcagcctccgtctgggagctcttgaggctacacaagacattccaggccctagagagactggagcaccctgttcccggcagagccctcggctctgagctcggmccagcatcaaaacatctcacggagccccagctcatctcatgagctaccccatcccggcccacacctgggcacacctcccaccccagcagtgggcatgaatcaggcagggccagagccggagagaaaatgccaagtgccatgaaaacagggcaccaggccggagcagggacagagagctatagcttcgcagggacagaggggtggccagagtgacccagagagaaagctgggggaagggggcatcagggaagccccagccatccccctcccatggaaggagtgttgggggagctatgcagatacagaagtacaggaacgttcggctgcttgtatggccaggaaaatgggcgtaggtcgctgcgtgtctgagagcgggtgtatccgtgtgtgcggccatgtatgtctttgtgtgtgtcagcaaatgtagraatgtttgcctttttatccctgtggcaaggagggggaagngcggtttcttgaaganaggtgggtna

SEQ ID NO: 4981 - DNA, 706 bp, Homo sapiens
gtttttgtgtatctgtcttaggcttttttatttgaggttaccattaagcttgcaaataacatgttataagccattatgttaaagtgatgacagcactgattgaaaaagaaaaaaacaaattaacaaacaagcacagagataactaataacactacatttaattttattcccctttttaactttttatttatttatatattatagtgctatgtcttgaaaagttgttgtagttattattttgataggtttatcttttagtctttctacacaagatatgagtagtttacacactacaattgcagtgtcataatattctgtgtttgtctgtgagtwttgtaccttcagacaatttcttattgctcccttttctttcagaatgaagaactccctttagcatttcttatagcataggtctggtgttaatgaggtccctcagctttttgtttacctgggaaaatctttatttctctttcacgtttgaagtctatttttactggatgtactattctaggatgaaagttttttccttcaacactttaaatatgttatgtcactttctcctggcatgtaaggtttccctgagaagcctgctgcaagatgtgtgggagctcatttgtatgttatttgtttcttttctctyactgccttcttttaagattctttctttatccttgacctttgggagtttgattattaaatgcctcga

SEQ ID NO: 4982 - DNA, 1278 bp, Homo sapiens
  misc_feature (108)..(108): n equals a,t,g, or c
  misc_feature (1035)..(1035): n equals a,t,g, or c
  misc_feature (1243)..(1243): n equals a,t,g, or c
ggcacgagggataatggaggctactataaaaattgaatgagaaagtcagtgagatgcactgtttaatttcctttctggctctttcactgtttctttttgttttgtttnttcccttttccttgccaataaaaaatatttgttgagtaactcasgcctactgtacaaagtaacaattctctcctccctttccatcttcttcctctccagtyctacttctgaraaagtaatccttaataacagtttggtgtgtatccaaaaaagcttttttgtagcattattctccaaagtgtttgaagcatttcttctgataaagtttctttagtctttagccagaactagtctttggcccacttagtctattgataaacaggaaatagcacatattccccccttgaggstagaatggcaggcctaaaatgagtaggagaattctgagaaatggaaactttaaaaaggcggcaaccttctagtttcattctcagaaataccaaagcagcatttttcctggacttgttctgcagakcgctcagatttgaaagccatttctagcctttgaggattaccactgtcctcagccaaactgcagggactcctaagtagatcagagctcctggaactttctcatcttttcagcatctcaaccctgtggaatcttttaactcccaaggtaagtacagattgtccagagagatctaagccatgcttattcaatggaatggagagtctctcaaagagacctcataactctaagatgaaaatctcctctgtggctacagacttttccagatatacccactttaggcaagagaggatgaagtagacactttaggtctacacttttaataaataagtgaaatagacaatgagaggagctggtccttagactgtactcaccttgtagctgaggccagggatgtaggactcaagcccagaggaacctggctgggctgagagaaagagatgtagagggttctcatagttctggggaacaaaccttcagataagacaagtgaggagacttgggaggaagggatncctgtgaagattctcttttttttttgagacaggttctcactctttcgcccaggctgtcgtgcagtggtgcgatcacaactcactgcagcttcgaccttccagggctcaaaggatcctcctgcttcagcctttgaaagtgcggggactacaggcactgagcgtgagggtgcctggctaatttttttcgtttctgtagagaggaagtctngctagattgaccagtctagtgggcaatcctgcaaa

SEQ ID NO: 4983 - DNA, 565 bp, Homo sapiens
  misc_feature (565)..(565): n equals a,t,g, or c
aaaaattcttaaaggtgagaactcaaggttcgattcttcaggtgggagatgtggctgatgctgattctctcattgacatctggggaaactgasgctctgagagggtgctgctccagctcctggacatacggtgaatcagcagcaggcccagcagaccaggccccctgcctgtgagcacactgacccttcccctcctcactcagccctggtgtgtcatctccaggggaggggtgctgcctccacgtgggtgatcagascagtgccagggaaagcaccaatttcagggtgtgcagctgcaaagctctgcgtgtatgtcccttctycccttccaccgggcctcaccccctttggctggctacctcccccaaacactctatctgcttttattcaccctctgacgcccctcctggcaccaagcctgcttcccaccatcactacatccgtcccccaaggctggagtccaatgccttccccaccagctgcctttgaccgccagtgaccctggcagctggtggggagggtgtcctccgyctagcctcagactctaggttggctggccttgtgn

SEQ ID NO: 4984 - DNA, 320 bp, Homo sapiens
  misc_feature (305)..(305): n equals a,t,g, or c
  misc_feature (317)..(317): n equals a,t,g, or c
gaattcggcacgagtcaccacgtgctgagtgctgtgcatggcgctgtgtgtcttcaatgaacagccggcgaatgcaggaagaaggcgaggaacactgaccttcatggtgggcggagaaggagcacccaaatggggatgtgtcacctgtgtgtccatgtcggtctactggtttctctgtttccatctcaggctgcaggcttcgtgtggatgaggatggcacctttcctgttcactgacagatactcagtgcctagcacagtgcctgggacacaggaggtgctcgtagggggggttccggtacccantcgtccctgatnatg

SEQ ID NO: 4985 - DNA, 537 bp, Homo sapiens
  misc_feature (511)..(511): n equals a,t,g, or c
agctgaaaggtgggggaagggaacgtagacctagagaggggaattcttacagaaatcctctttttttggtcccttctatttttcagtctccggcagcctcttggtcatgaaagccctcagattgtcggcttccgccctcttctgccttctgctgatcaacgggttaggggcagcaccccctggtcgccctgaggcgcagctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcgngttccgcctcgccctcagaactccgg

SEQ ID NO: 4986 - DNA, 661 bp, Homo sapiens
  misc_feature (530)..(530): n equals a,t,g, or c
  misc_feature (553)..(553): n equals a,t,g, or c
  misc_feature (573)..(573): n equals a,t,g, or c
  misc_feature (611)..(611): n equals a,t,g, or c
  misc_feature (642)..(642): n equals a,t,g, or c
  misc_feature (654)..(654): n equals a,t,g, or c
ggcacgagtgcattgcaggatgtccacctgttgtacctcagcattgcagtacctcctggcacttttccccctccctgcccccaattgtgtgtcctatagaagtcaaggcagcagctgttacctgcttttacagattcagaaaccaaggctcagggaagagcctgagtggccccagccacagagcaagtcaatgcgaggcagcatgaagctaggcttctttccacattgcacccgcctcctcccttcctggggaggcgggggcagatgtagtggctgacatgacagtagagaaccctgtctagggagtgcacagggtgagatctggctcccctggctgtggaccctggcctcccacccctgcgggaaggctgggaatgtgggggtgcctatgtgggcacgcagcactccccaaatctggagtatagtaaagctgagagcaccctacaccaacccccacccatggtctctctagccccatggggagccaagctgtgtccccaccccagcctgtcccccaaggccctggcttnagggaaagccccagcaagcttgnaccatagtccacaaggcctncccaagggcttccccgggaaccagaagcttgcaaccangtccaaatttcccaagcaacttcaaaggaanacttcttggggncaatttc

SEQ ID NO: 4987 - DNA, 779 bp, Homo sapiens
  misc_feature (6)..(6): n equals a,t,g, or c
  misc_feature (25)..(25): n equals a,t,g, or c
  misc_feature (28)..(28): n equals a,t,g, or c
  misc_feature (38)..(38): n equals a,t,g, or c
  misc_feature (50)..(50): n equals a,t,g, or c
  misc_feature (130)..(130): n equals a,t,g, or c
  misc_feature (182)..(182): n equals a,t,g, or c
tcagtnccacaggctccctttcctnccntccatgatanactgcacttacnataaggctcgtggcccattagagcccagtcactgtaggagtctgcaaactttccctctaaaggcccagacagtcagtatnttaggctttgcaagccatatggtctctgtggcaactactcaacactgcagtnacagttaatacagccgtagacaatacataaatgaatgagcatggctgcgtccaatgaaatgttatttatggacactgaaatttgactttcatataattttcatatgtcacaagatatttttgttttgactcttcacaaccatttaaaaacataaagactattcttagcttttgggctgtacaaaaataggtggcagatcagatttggcaggcccatgggttagagmaaggtccctggagccaacctgcgtgggtatgaatcctggctctgctgggtgtcctttggtaagtgggtcaacctctctgtgcttcagagttctcatctataaaatggggatgatgatgatgatactttggggatgtaacatggtgcagtcacattggaaaagtttggcagttcctcaaaaggttaaacataaaagttaccatatgatccaggtgtggcagcacatacccgtagtcccagcaacgcaggaggatcacttgagccctggagtctgaggtggccatgagcgatgattgcactactgcacaccagcttgggcaacagagcaagaccttatctcaaaaacaaaagttaccatatgacacagctcga

SEQ ID NO: 4988 - DNA, 655 bp, Homo sapiens
ggcacgagccaggctgccttcatctcctccactgtggccaagctgaggatgcctcctggactttgccccagctcccgcacctgaggtgctggcgaaccctagacaggaacatcctgctggacgggcagagctctgagaaggcactcacgcagccctgggtgcctcctaatggtgcgggggctctggaggcctcatcagatgccttggggaggggtgtgggacactttcatctccgccccctccatttccagatgcgcccaagagctggctgcctccccggcccctgcagagagatgctgcctgctctgaggggcctgctcttcgtcacgtgggttttccccctggaagaccaggaagcagctgcttttcctggagaggtggatcccccgagtccattcggtccttgcacagcagaggggcccgcggcgctccctgcccgtgtctggtctgtaaagcaaggactcaggcccttcagctgctccgatgccccacaaggcgacagcagagagctggccaagcctccagggctcccgcctgttcgaggtgctttggtaacgtggccaccaccccagcctaccgggctctcacgtctgcgttgtcacccccacggcacaggagggaaccacagcatcagatgcaggaggtgccgcccagg

SEQ ID NO: 4989 - DNA, 162 bp, Homo sapiens
  misc_feature (158)..(158): n equals a,t,g, or c
tttttttatggtttctttataaaagttccaacacctctatctttctcttattgcttatcttacaaaatgtggaacaatttgcagaatattaatatcatgtcttaagtattgccttaaatggtttgtgggatattacttgatattcaccttcttgatanataa

SEQ ID NO: 4990 - DNA, 1146 bp, Homo sapiens
  misc_feature (1)..(1): n equals a,t,g, or c
  misc_feature (8)..(8): n equals a,t,g, or c
  misc_feature (21)..(21): n equals a,t,g, or c
  misc_feature (825)..(825): n equals a,t,g, or c
  misc_feature (839)..(839): n equals a,t,g, or c
  misc_feature (853)..(853): n equals a,t,g, or c
  misc_feature (870)..(870): n equals a,t,g, or c
naatgctnccccactttgggntcaaaagccggagctccaccgcggtggcggccgctctagaactagtggatcccccgggctgcaggaattcggcacgaggtggctgtcacagctcccgtcccttccaggagctgctcagggtgggagttgctggctgcctggcttggtccaggtctggagtggacgttgaggggtgtggcccagatggtgcgaaccctgagccttgctgtcctcagttggctgccggcggctgtctgctgarcccacagcttgcctttggtcagagggagcccacagctgttcctcccttctgttggccagcagctatgtggccatggggcagtgtgagtgccctctggctgcagttacatccaccacaaatggacaaacggggtggctgagagaacaggaatgcactgtcccagttctggaggcagatgtcttgggtcaaggtgacagcaaggctgtgctccctctgagggctcttggggagggtccttgcactcccctggtgggtggctgcaccattctggtctcagccttggccttcacacaacctctcccctgcatgtgtgtatctccctctccctccccttaaaagggcctagtcgtagaatttagggcccacctaccacactaagatgagcatgacctcatcctagctcattccatctgcaaagaccctgcttccaaacacggccacattctggagttccaggtgggtgtgcattttgggggatggcctcttctgcgtggcacatgacggaaaagggttctaaccgagggacttctgtgtggggcctcactctgattctcatccttagngctgggtacacggnaatggcccctttgngaaattcatcaaacggnggacacttagggcatgtacatcacacttaaaaagtctgcattaaaatagagggtcaggctgggcgtggtggctcacgcctgtaatcccagcactttgggaggctgaggcgggtggatcacctgaggtcaggagttcaagaccagcctggctaatgtggcaaaaccctgtctctactgaaaataaaaaaattagccaggcgcagtggcacatgccttgtaatcccagttactcaggagactgaggcaggagaattgcttgaactcaggaggcagatg

SEQ ID NO: 4991 - DNA, 158 bp, Homo sapiens
tgaaaaaaaaaaaaaaaaaaaaaaaagaccgggcgcggtggctcatgccttaatcccagcactttgggagactgaggcgggcggatcacctgaggtcgggagttcaagaccagcctgaccaacacggagaaaccgtctactaaaaaaaaaaaaaaaaa

SEQ ID NO: 4992 - DNA, 368 bp, Homo sapiens
  misc_feature (5)..(5): n equals a,t,g, or c
  misc_feature (13)..(13): n equals a,t,g, or c
  misc_feature (35)..(35): n equals a,t,g, or c
  misc_feature (351)..(351): n equals a,t,g, or c
  misc_feature (367)..(367): n equals a,t,g, or c
aatgnaactctcnttactaattggaaccaaagctngagctccaccgcggtggcggccgctctagaactagtggatcccccgggctgcaggaattcggcacgaggtccaggtgtctttatttcagatgttctgtttttcctctattttctgctcacatgaacatacacacttgccaggcacattctggcttttcttatttctctttctgattttgcctccttcctgcccctgttttcttcccttttctctggctatagaaactgtcaggtggccttgctggcatcatcctacctcttttgaactgtgttacccaggaacttccatttattatgcctcgagggggggcccggnacccaattcggaagant

SEQ ID NO: 4993 - DNA, 2637 bp, Homo sapiens
  misc_feature (1101)..(1101): n equals a,t,g, or c
  misc_feature (2524)..(2524): n equals a,t,g, or c
gctccaccgcggtggcggccgctctagaactagtggatcccccgggctgcaggaattcggcacgagcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgawmtgyaggactatcatggaggagmyyatggaggtggttgggctggaggagcaggggcagaattttgtgaggcatactccagagggccaggaggccgcagacagggatgaggtctacacaatccccaactctctgaagcggagcgactyccctncmgytgtwctcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgmcaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttyagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccattgctccagaaggccacagagtggtanaaaatyacaggtaaaggctcagacagcccctgtgatattggtggtcttatccttacattcttctcccttggctaagacaggacttaatatgaaaagtccagcacccaggccac

SEQ ID NO: 4994 - DNA, 649 bp, Homo sapiens
  misc_feature (646)..(646): n equals a,t,g, or c
  misc_feature (648)..(649): n equals a,t,g, or c
tttcgttttattgtattttgcaaagtgtcagtcagcgacagacagggatcggggcactgagcagggactgggccttcacttccagccagcgtggagccctgccagccagcacacgggagtggcacctcatcccatctctggttggggaggtgggtagccagggagtgacagctgagacctgtgggtaaggagacccttcacaagttcagggaccagttgcctcggaggggctgtgggcctctgaaaacaagggcccacaggaagaagcggtggtgggtggaacctgtatgtccatgatgccccagacctgagtgcgggtaggctggtgaaaagcaccggatcggatggactctggaggatggatggacggtgacacccgccaggccttcccttgtccttgggggctggtgagtctcccattggctggtgtcactctggctctccacgtgttcactgccagcgccctccccagggagctgaggtctgaaaaggactggccaggccagtctcctgggcccatcgtctctgtcccaggcagmcaggaggggatactcgagggggggcccggtacccaattcgccctatagtgagtcgtattacaattcactggccgtcgttttacaacgtcgtgactgggaaaccccanann

SEQ ID NO: 4995 - DNA, 748 bp, Homo sapiens
  misc_feature (669)..(669): n equals a,t,g, or c
  misc_feature (682)..(682): n equals a,t,g, or c
  misc_feature (685)..(685): n equals a,t,g, or c
  misc_feature (724)..(724): n equals a,t,g, or c
  misc_feature (728)..(728): n equals a,t,g, or c
  misc_feature (734)..(734): n equals a,t,g, or c
ggttggtgcctatgtccttttgacatgaccctgtcagttctgcagcacttctttatatgtgttcttttgattttgcttttagataccaacctttgcagacagattagctcacatagttttgaatttagtgggaaccaaccccttgtattttgctgtatttctagtatctctgctaaattggtactagatcaggcaggatgacttaatgcaacagttcttaaacattttggtcttaggacccctttatgcatttgaaaacatcattgaggatcccaaagagctttttctgtaatgtgaattatatctgttgatatttatcatatttgaaattaaaactgataaaatttaaatacaaaaatgtgtaaccatatatcctattagccatcagagtgatgccaacatcaaacatcatatagcttctggaagacttcagagcacatttattagagaatgagagtgaaaaagtcaaataatttattggtgttatcatgacaataattttttgatatgtggaccccctgagatggtcttagggacaatgctaaagactactgktttaaagtatggcaaagaagraaaccaccttatgggaagrtttcatgagtctttctcaaagggactcccttggctaaaccatcctaatccttccatgggacctaagccattcancctttwaacccanggnccttttaaggcccaattggtaatttacctgggggagccncctnccctcnaaaaatgccaggag

SEQ ID NO: 4996 - DNA, 991 bp, Homo sapiens
  misc_feature (11)..(12): n equals a,t,g, or c
  misc_feature (23)..(23): n equals a,t,g, or c
  misc_feature (880)..(880): n equals a,t,g, or c
ctcccttttgnnttatgggaccnatcccgacaataattttttgattatgtggaccccctgagatggtcttakggactttgctaaagactactgttttaaagtattggcaaagaagaaaaccaccttatgggaagatttcatgagtctttctcaaaggaactccttgctaaacatctatcttcatggtacctaagcatttcaccttttaaccaggactttaggccattgtattactgggagctcctcctcaaaatgcagagaaagctcaaagactaatttttatctattgttaataattcaatttaaattggcttattaaatggcttttcagttacttttcaggatgttgagatacttggacttaggataggtatgttttatggggaagacttgggaggttatagagaaataaaggggagaaggaaagggtaattgagagcatgcctctctgctgagaaggtggctccatgtggaacaccacagccttgctttctcctctatgtctcctgccctctcaccctggctggctgctcaccaacccttccatacttatcctaaactttcaactatgggtgcttttttgtatttgtgaattagaaagaggtagcttgggctttgcatatttaagcagattgggaaagttgtaaacttttgagtcccttagaataactcagtcatgtatttctcttcttagtaaaaattcagaaaaattccagagtagtgcaaacctgcttagagagaggtgaaaacagaagaagactgttgtgtttaactgaaactgaaactgcaaatgaaggggtttttttgwcattatatgctttctttttggtttgkattcctcaatccgtgccttgataacaattcataaatctaggttcanagagtacaaaatccatattactactaggaatcataaggctttgattaaaataatttttttgaactttcttctatggctattctgagctcagaaagagtattttattaattt

SEQ ID NO: 4997 - DNA, 1147 bp, Homo sapiens
  misc_feature (1119)..(1119): n equals a,t,g, or c
  misc_feature (1132)..(1132): n equals a,t,g, or c
  misc_feature (1142)..(1142): n equals a,t,g, or c
  misc_feature (1147)..(1147): n equals a,t,g, or c
ggttctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcarggtcttcacctccacatcccaaacattttcccagccaacccggccaacatctctgtggccctgagagcccagggcagcagctacacggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcamraaaaaaaaaaaaaaaaaaaaaaaaaaaaaaanaaaaaaaaaaaanaaaaaaaacnaaaan

SEQ ID NO: 4998 - DNA, 439 bp, Homo sapiens
  misc_feature (434)..(434): n equals a,t,g, or c
  misc_feature (439)..(439): n equals a,t,g, or c
ccacgcgtccggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcaaaaaaaaaaaaaaaaaaaaaaaaaaaaaaaaaaaaaaaaaaaaaaaaaaaaaaaacnaaaan

SEQ ID NO: 4999 - DNA, 1072 bp, Homo sapiens
cttattggatccccccggggcttgcagaattcggcacgarcactcatctcaggccacacaggattccattcatcgaacattcctgagacaacggaattctggtgatggagcacaggtcagtggtggccaggggccaggtgtggctatgaaggggtggctgccttgtgacacccttgaggcccgtgcaagctgttggcatgtcaacagttagctgcttctcattgctgagtggcgattggtcctgtcatggtttattcagccatgtggtggatggcaacttgtcttctaagccacttgccttctgattgctggactgactctctcgccctctcttggtgcagccctcgggaggctcagtcacactctccgagagcacagccatcatctccaatggcatcacaggcctggtcacatgagatgctgccctctacctggcagaatgggccatcgagaacccggcagccttctctcataggtgacctcggggcgcacggcaggacaccgaggcaggctcaccctggtgcagttacagacatggtcccctttcctcccgccaggactgtcctagagcttggcagtggcgccagcctcacaggcctggccatctgcaagatgtgccgcctccaggcatacatcttcagcgactgtcacagccaggtcctcgagaagctctgagggaatgtccttctcaatggcctctcattagaggcagacatctctgccaacttagacagccccagggtgacagtggcccagctggactgggacgtcgcgacggtccatcagctttctgccatccagccagatgttgtcattgcagcaggcaatgcccagccccaggactctgtgcaggcggtgtccttgcagctctacccagctctgggctctgggaaaagggaacaatggacgctgtcgggcatggacatgatggggcttccagaagagttactctgggcctccagggtgacatcaaaggacaggggtgcctcttaaggtgaccttccagccacagccctcttgttggagacaggcatactcccattacagtcatcaccacatggctctgtcccag

SEQ ID NO: 5000 - DNA, 622 bp, Homo sapiens
  misc_feature (30)..(30): n equals a,t,g, or c
  misc_feature (605)..(605): n equals a,t,g, or c
  misc_feature (618)..(618): n equals a,t,g, or c
ggccgctctagaactagtggatcccccgtnctgcaggaattcggcacgagttgtgacatggttctgtctcgtttcttgattagttttatggtttcctgttgggaccaaaatttgatcttatttctaacctgcttgttggcagtcctgatattttgcctggttctagctgtgtacattgttttttttaaattcttaaaggcaagcttgatttatgttccaagagaatgggtcaccttgaccaaggctaatgatgttcagaaaggccatgacttggggctatcttactgcaggacgcaatccactgcttggccaccaccctgccttggacatcatctccatcttgaatcaagcctaactttggaatcatttgggctactgaccattcccattagtgattctgtatcactaattacttgactaatcccagtcttgctagtctcaactttctgcctttcagcactggctccctgttggggttacagtgtgctatttggctgaactcatctkaattgcascaagcatctaaattgcagctggcatctcaatagctycagstctatagaggttgcaccacagactctcttgctcgttctaatcttaaaacntggattaacaacntgga

SEQ ID NO: 5001 - DNA, 815 bp, Homo sapiens
  misc_feature (4)..(4): n equals a,t,g, or c
  misc_feature (48)..(48): n equals a,t,g, or c
  misc_feature (64)..(64): n equals a,t,g, or c
  misc_feature (73)..(73): n equals a,t,g, or c
  misc_feature (111)..(111): n equals a,t,g, or c
  misc_feature (199)..(199): n equals a,t,g, or c
  misc_feature (202)..(202): n equals a,t,g, or c
  misc_feature (277)..(277): n equals a,t,g, or c
gggntttaaataggtttggacccaaatggttgccaggaaaaggaaaanaatatttttcaggggnaacctgggnaaggaaaaccccaggcagtatcttcattttccctaagnatatttttgaccaatgccaaaaatcatagcccaacatttattgagcatttattatgtgccaagtgctcttctaattgtcttacatgantcnactcatgtaaacctcattacaacctgatgaagtagatactattattacccccattttatagaaaatgaagcaaanatagagaacttaaataacttgccaaatgtcacgggtggtaactgaggtgtcaggattgatgcctcgggtagtctggcggctgttttacctcttaaccattatacaattacagagtttaattttttacagtttcagggaaawacagagctttcctctgacagtaaaattagaatatccaaccgggagtggattcacctaagaattggtgagactgatatacatgatctgaaacaaaagtctgaaacaaaattaattaactaactaatgaaagtcaataactaaggtcaaagmaggtcagaaaaaatgcaaaaatcagactcaccaacaaatattcatgttgcagtacatggcttgaagcctgttactgagaaatggtcttgtggtgcaacaatactaaagttcccatgaactttaagaagttgaccaacttatttcaaagtattggcatgctgagttgtcaaaatgacatccctgatttttttggtggagatggggtttcgccgtgttggctgggctggtctccagcycctgacctcga

SEQ ID NO: 5002 - DNA, 1518 bp, Homo sapiens
gggaagagccccacggccagctccttcctgttcccctggcggcccctcgcttcttccttctggatgggggcccagggggcaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagatttctggaaggagttatttatgagtgaagagctggagaatccattcgcaaactgatgcatgaaagtgattagcaagagaaagttgtgagacaaaacagagaagctgagaggccagaaacctctacccaggacgctgagctcctggcggatccgatgagtccctccaggacaccgtccaccctgggatgaaggcagaggagttggaaggaggcgaggccgtcacgggacaacaggaccctatgaaggtgggcccacagcaaaaggagagatgattctagagcatccagtcttctagggcagcaaaacaacctaaattttctaagaggccacccagctgagggtgcccccgggragggctraggcgtcagggtgacggctccaytgccmaytyacctgcgacctyaaagcccytctcytccatggggtgctcctgacagccacctccagggcaggcgagtggcgctgggacaaaggctggcccgactgcgccccacccaagcagacggtccttcccccagacctggcgccaaactggagtgaaagcccgaccaccgtgtctcacagggaaactgacaccagatgcgaacttccaaatggatccctycctgcaagtgtggastggcgctaccaggcactgctytggscatgcgtctaagacacaggcagaggcgctgsccaccacgctkgcgacggsctcaaagcccctgttcatgcctgggacagcgcccaaggaccttgctcatgcytgggacaggccccagggcccccactggctgcagtcagcagcgggcagggtggtgggggaaggtatggacactccgtgggccggagctgggagaacaaggcctattattggacacctggtggccatggcaaccacacaaggatgcctgagactgaaaatctgtgggcttcaaggagctccagctcttgcactggctgagtcacagtgactatataactcttactcccacttttgggacactttttgagagggacagggatcctatctaactacacgggatagacatcgcccaagaccgtcctgagcaagcctggacgctgtgaccctaacgatgaaggtgtcccgcagacaatgtccggggcaggcaccatgctctcccaacctaccacagccagatgtttttgtaaagaacaataaaaatgaattactagaaaagcaacggcacgag

SEQ ID NO: 5003 - DNA, 1125 bp, Homo sapiens
gcccacgcgtccggaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgggtcttcccccaacagaactatttcttgctgctcaatccatttcctctggcccagcttcccagtgctcacagatggctggcccatgtgctggaagatgacacagttgccttctctccgaggaacctgccccctctcctttcccaccaggcgtgtgtaacatcccatgtgcctcacctaataaaatggctcttcttmtgcaaaaaaaaaaaaaaagcggccgctctagagratccaagctggcgtgggcgcg

SEQ ID NO: 5004 - DNA, 652 bp, Homo sapiens
  misc_feature (7)..(7): n equals a,t,g, or c
  misc_feature (645)..(645): n equals a,t,g, or c
attaccngcatgccccacccggcctggccctgattacattttaaaaactgcttggttgcttaagactcttgtcaggtgaacctttgtagtgctgataattgtatgtatctaacttcccagaaaaggatttaaatgtggtatagaggtaggactactaatttactattaagaggggtgggaatggcttgcactgtttggttactctggtaaccaccaaagtgctgcattttctaaattgaaacaaagttgggtgtgcagagacagactagaagtggagcttcatctctgaagtaatgcatgttgttcattggagcaggctatttcttttgaagcctccttactctgtacatgcaacctttattcccaccgggttcttagcaagatttagaacacctggaattcttgactcttgcttcttccattcatggcctcttttgctttcatacttcctttccccccaatctcctcttctgaaataacctgaactgtctatggtcttcttatcccacttgtttggcaccaagagattattccttctcttggccctaatttgggcttcttggcatttttcctatatgcctgcggacgcgtgggtcgacccgggaattccggaccggtacctgcaggcgtacctttctatagtgncacctaa

SEQ ID NO: 5005 - DNA, 811 bp, Homo sapiens
ccacgcgtccgccagcaccttcctctcccaggcaaaatgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccagcaaatacacctgggtcaagtacaaccctctggagtctctgatcaaagacgtggattggttcctgcttgggtcacccattgagaaactctgcaaacatatccctttgtataagggggaagtggttgaaaacacacataatgtcggtgctggaggctgtgcaaaggctgggctcctgggcatcttgggaatttcaatctgtgcagacattcatgtttaggatgattagccctcttgttttatcttttcaaagaaatacatccttggtttacactcaaaagtcaaattaaattctttcccaatgccccaactaattttgagattcagtcagaaaatataaatgctgtatttataaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5006 - DNA, 755 bp, Homo sapiens
cactcgctccggatttcccgggtcgacccacgcgtccgccagcaccttcctctcccaggcaaaatgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccagcaaatacacctgggtcaagtacaaccctctggagtctctgatcaaagacgtggattggttcctgcttgggtcacccattgagaaactctgcaaacatatccctttgtataagggggaagtggttgaaaacacacataatgtcggtgctggaggctgtgcaaaggctgggctcctgggcatcttgggaatttcaatctgtgcagacattcatgtttaggatgattagccctcttgttttatcttttcaaagaaatacatccttggtttacactcaaaagtcaaattaaattctttcccaatgccccaactaattttgagattcagtcagaaaatataaatgctgtatttataaaa

SEQ ID NO: 5007 - DNA, 774 bp, Homo sapiens
  misc_feature (760)..(760): n equals a,t,g, or c
  misc_feature (763)..(763): n equals a,t,g, or c
cctctgtccactgctttcgtgaagacaagatgaagttcacaattgtctttgctggacttcttggagtctttctagctcctgccctagctaactataatatcaacgtcaatgatgacaacaacaatgctggaagtgggcagcagtcagtgagtgtcaacaatgaacacaatgtggccaatgttgacaataacaacggatgggactcctggaattccatctgggattatggaaatggctttgctgcaaccagactctttcaaaagaagacatgcattgtgcacaaaatgaacaaggaagtcatgccctccattcaatcccttgatgcactggtcaaggaaaagaagcttcagggtaagggaccaggaggaccacctcccaagggcctgatgtactcagtcaacccaaacaaagtcgatgacctgagcaagttcggaaaaaacattgcaaacatgtgtcgtgggattccaacatacatggctgaggagatgcaagaggcaagcctgtttttttactcaggaacgtgctacacgaccagtgtactatggattgtggacatttccttctgtggagacacggtggagaactaaacaattttttaaagccactatggatttagtcatctgaatatgctgtgcagaaaaaatatgggctccagtggtttttaccatgtcattctgaaatttttctctactagttatgtttgatttctttaagtttcaataaaatcatttagcattgaaaaaaaaaaaaaawwaawaanaanaaaaaaaaaaa

SEQ ID NO: 5008 - DNA, 3239 bp, Homo sapiens
ccacgcgtccgcggacgcgtgggcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaaaaaaaaaaaaaa

SEQ ID NO: 5009 - DNA, 3339 bp, Homo sapiens; identical to SEQ ID NO: 2622

SEQ ID NO: 5010 - DNA, 3265 bp, Homo sapiens
ccacgcgtccgcggacgcgtgggcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctggtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgcctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaaaaaaaaaaaaaaaaaaaaaaaaaaaaaaaaaaaaaaaaa

SEQ ID NO: 5011 - DNA, 1319 bp, Homo sapiens
  misc_feature (21)..(21): n equals a,t,g, or c
  misc_feature (28)..(28): n equals a,t,g, or c
  misc_feature (56)..(56): n equals a,t,g, or c
ccgctgtagtcccaagatagnttgtgtnccgccggtgtcgccatgctcaagctatnacttgcccgaytcatccmcggtcatcctggacacttggttcgtgtggcctttcccagcgaaggagtcgttctcccccgtctctgaatcccagtaattaatgtgtccgtcgtggctcccagagtaaatgtaggacttgccgccgtttttatgcaccgtcagacactggatcgatttactgtgacccttgatgacgtgcaggggcttgctggggttgtttctgtccagatagttgatgtacccggacagggagacactgagcaggtggtccttctgccataggcagcccagctgctggtccagaaccgtggagcccatgggaaatgtgctgaccacggagttcacgctgacgtcccaaatcttggaagttttgtccccagaagcagaaagcaaatgggtgctgtcgggactccaactaattgcgtaaatcccaccgtcgtgggccttgcttccgcccagcgcgcacaccttctccccagtcttcccgtcatagatgtatatctggccgtcagcactggctgtggcaaatctgttcccatcaggagagaatcgcacacagttgacaaagcggctgtggtcgccaactgtgaacttgaacttgaatgggggtccctcaaagaatgccgcgcagttatcatcgcttcccgtggccagccggtatggccggctctgcttgatgtccacgctgttgatgactttgttgtgtcctgtaatctcgcccacagaagagccactatcccagaggaagactgctccaaacttctcccttccttccccgaccacggcgatcctcttactgtcttcagtccaagcaatgtctttgatcttcccagcgaaaggctggtactcatacttcaacaggtgctccttctgcgtggtatcccagatcctcagcttcccagacacatctccggaggcaatgtagaatccgctgggcgcatacttggccaccaccacctgatgggcgtgctctgtgtagatgtcagcaagggctgggttgtcgatgttccttaggatgacgcactttccattggtgtacagaaaattgttgcccttagggtcgccgccgatgatcttggagacgcccctctccacctgcgggaggctggcgaacaccttcttgatctcgtacggcatcctcgcccacttgttaccgcgccgcgctcgccgagagcctccggggccggcccgcgctgcgaattacacctcgccgaggccgagcccggggtcgacgcggccgcgaatccgggtcgacgagctcacta

SEQ ID NO: 5012 - DNA, 729 bp, Homo sapiens
  misc_feature (687)..(687): n equals a,t,g, or c
  misc_feature (723)..(724): n equals a,t,g, or c
tacgcctgcaggtaccggtccggaattcccgggtcgacccacgcgtccggctaggtggcagcggagccaagctgacccggcgagcggagccggggctggagagcggcgaccactgcggatctcggaaggaagaaatgatgtaaatcactcatccaaactttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctctggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgcttttggcatgtgctcttctgcattagtggtgtttgtctttggtgcgctcacagaatggctgcgtttctacaacaaatggctgtactgctgcctgtggattgtgaacggcctgctgcatccactggttggccctgtgtgggtgctgntatgggcactgggtttgggaaaagccgggtatgccnnctttc

SEQ ID NO: 5013 - DNA, 756 bp, Homo sapiens
  misc_feature (2)..(3): n equals a,t,g, or c
  misc_feature (7)..(7): n equals a,t,g, or c
  misc_feature (30)..(30): n equals a,t,g, or c
anntctntgattaccaaattgctatttagntgacactatagaaggtacgcctgcaggtaccggtccggaattcgcggccgcgtcgacgtccctcaaagaatgccgcgcagttatcatcgcttcccgtggccagccggtatggccggctctgcttgatgtccacgctgttgatgactttgttgtgtcctgtaatctcgcccacagaagagccactatcccagaggaagactgctccaaacttctcccttccttccccgaccacggcgatcctcttactgtcttcagtccaagcaatgtctttgatcttcccagcgaaaggctggtactcatacttcaacaggtgctccttctgcgtggtatcccagatcctcagcttcccagacacatctccggaggcaatgtagaatccgctgggcgcatacttggccaccaccacctgatgggcgtgctctgtgtagatgtcagcaagggctgggttgtcgatgttccttaggatgacgcactttccattggtgtacagaaaattgttgcccttagggtcgccgccgatgatcttggagacgcccctctccactgcgggaggctggcgaacaccttcttgatctcgtacggcatcctcgcccacttgttaccgcgccgcgctcgccgagagcctccggggccggcccgcgctgcgaattacacctcgccgaggccgagcccggggtcgacgcggccgcgaatcccgggtcgacgagctcactagtcggcggccgc

SEQ ID NO: 5014 - DNA, 324 bp, Homo sapiens
  misc_feature (225)..(225): n equals a,t,g, or c
agtatgtactctttttttgagtgatcttttttttttttttttcctgtagagaaagggtctgtgttgcccaggctggtctcaatttcatggcctcaagctattctgcctcggcctcccgaagtgctgggaatataggcatgagccaccacacccagcctttgtgtcttctttcattcagcataattataaatttattcatgtttattcattcacctgtggatgaanatttgggttgttttcagttttgggcggttacaaataaagctcctgggaacatttgtgtacaaaaaaaaaaaaaaaaaaaaaaaaaaaaaaaaaaaaaaa

SEQ ID NO: 5015 - DNA, 2088 bp, Homo sapiens
ccacgcgtccgagcagctgctggaggctagggattgtctcaggtgcctggagcccctcaccccttgggagaagtgggcgtctgtcttcagacatcagagctggccccaggccacgtctgacccagagctgcagccgtgaggttccctcacggtgctgtccctggcaaccagacccttgttgggcttatagatgagggtatcttgctcaaggtcatgctgcagcctgccccctataagcctctccctgaggttggtggcctcttgtcttccctgctgcctctgcctctctgcagcccccaggatgcaggaggagcctggacaccttcggcccagtcgggccaggcctctggaaggcccttcatgggactctccatccttggccccgccggcctccgcccaacgtcctcttcctcctccagtttcccgtatccttcccgccacttcgggcagggctgggaggtggtgcggatgggcgccatgccccaaaacagcagcctgagcaccgcagtgccttccgggatgggtgatgggtgccaagtgttctggccacccgccccctgccgctcacagctttcaccaccagcatccggctccttcccgctcttctccccgctccaggcacctccctccccctcatcggatccggcccaggctccaggatcctgtggaagcagctcccagcccaggcacgccccctgcagcccacccctccctctcgctgcccccagcagttaggaggcagccggtcccatggtgggccttgcagtccgaaatgtggtcccctggggggacagaggacatgggctcactgcgggagccggagttgggtcctcatctccctggcttggattcctgaccaggctgaaagctgggtccccagccacctttctcttcctccaccaggttccaggggggtccccctgtggggtgcctcctgggtggtcgcccgcaggccgccctccgcctgtgcctaggccagagccaggcactgacaccagcagggacgggcctgggggggacacccagtgccacagctccacccgcgccccacaggtggcagccgggggtgtctgaggaaactccccaccccgcaccactggagaatgttcccaggacctcgcctgctgcctgaaaagcccactctcgttctggtgcttattttcccttcctttttaggccatgatttctggagagcttgacattctcaaagactggtgctatgaagctgtgagtacttcctttctttttctttttttttttttaaggcctaaaaaatcaccatggagaagttccacttcggtggctccgttggggtagctcccaacaggcaggacctgggctcccggtgggggaatcctcacgtctcaccctccgagagcctgacatccccccctgcccctttccattcctcagcatgtgacatctgggctctcaggctggacaccgggtcacccgccagtcctttgctcccagactgtaaactttgttagggagaatccttctctgggctggtgtctaagagatggctggttgggggtgtcccctgggcctgtgagagatcacaaagctgccaattttactgggccttttttttccctccaatcttaaaataattttggttaggtctgggcacggtggcctatgctttcaatcccagcagcccaaggcgggagattgcttgagcccaagcattcaagactagcctgggaaacatagcaagatcccgtctctacaaaaacatttaaaatgagccaagtggcagggtgcggtggctcatgcctgtaatcccagcactttgggatgccaaggcaggcgattgcctgagctcaagagttcgagaccagcctgggcaacatggtgaaaccccatctctactaaaataaaaagttagccaggcatgctggtgcatgtctgtaatcccagctactggggaggctgaggcagtagaattgcttaaatccgggaggtggaggttacagtgagctgaggtcgcgccactgcacttcagcctgggcaacagagcaagattctgtctccaaaaaaaaaaaaaaaaaaaaaaaaaaaaaaaaaaaaaaaaaaaaaaaaagg

SEQ ID NO: 5016 - DNA, 711 bp, Homo sapiens
  misc_feature (667)..(667): n equals a,t,g, or c
  misc_feature (670)..(671): n equals a,t,g, or c
  misc_feature (698)..(698): n equals a,t,g, or c
ctgcaggtaccggtccggaattcccgggtcgacccacgcgtccgagcagctgctggaggctagggattgtctcaggtgcctggagcccctcaccccttgggagaagtgggcgtctgtcttcagacatcagagctggccccaggccacgtctgacccagagctgcagccgtgaggttccctcacggtgctgtccctggcaaccagacccttgttgggcttatagatgagggtatcttgctcaaggtcatgctgcagcctgyyyyctataagcctctccctgaggttggtggcctcttgtcttccctgctgcctctgcctctctgcagcccccaggatgcaggaggagcctggacaccttcggcccagtcgggccaggcctctggaaggcccttcatgggactctccatccttggccccgccggcctccgcccaacgtcctcttcctcctccagtttcccgtatccttcccgccacttcgggcagggctgggaggtggtgcggatgggcgccatgccccaaaacagcagcctgagcaccgcagtgccttccgggatgggtgatgggtgccaagtgttctggccacccgcccctgccgctcacagctttcaccaccagcatccggctccttcccgctcttctccccgctccaggcacctccctccccctnatnngatccggcccaggctccaggatcctgnggaagcagttcca

SEQ ID NO: 5017 - DNA, 579 bp, Homo sapiens
  misc_feature (215)..(215): n equals a,t,g, or c
  misc_feature (579)..(579): n equals a,t,g, or c
tctctgggctggtgtctaagagatggctggttgggggtgtcccctgggcctgtgagagatcacaaagctgccaattttactgggccttttttttccctccaatcttaaaataattttggttaggtctgggcacggtggcctatgctttcaatcccagcagcccaaggcgggagattgcttgagcccaagcattcaagactagcctgggaaacatngcaagatcccgtctctacaaaaacatttaaaatgagccaagtggcagggtgcggtggctcatgcctgtaatcccagcactttgggatgccaaggcaggcgattgcctgagctcaagagttcgagaccagcctgggcaacatggtgaaaccccatctctactaaaataaaaagttagccaggcatgctggtgcatgtctgtaatcccagctactggggaggctgaggcagtagaattgcttaaatccgggaggtggaggttacagtgagctgaggtcgcgccactgcacttcagcctgggcaacagagcaagattctgtctccaaaaaaaaaaaaaaaaaaaaaaaaaaaaaaaaaaaaaaaaan

SEQ ID NO: 5018 - DNA, 1006 bp, Homo sapiens
  misc_feature (861)..(861): n equals a,t,g, or c
gtaccgcctgcaggtaccggtccggaattcccgggtcgacccacgcgtccggtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcaggggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagytattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacagacattttgtgtatcatttttttgtttcttaatccaatattcctttacaaattaaatgccttgaaaaatataatgggagttcaatgtgattttgatgctttgggtctaacttctacattcctactgttaaaaaggccagtatatcttaaacaaatggantgggcctgggggcatattcagttggacttacatggaaaggttattacaggcaacagtaattaactaaaggggtggattcggctaaatccctttggaatggcggcgggtttggataaattttatttttgggccattcgggtttggg

SEQ ID NO: 5019 - DNA, 700 bp, Homo sapiens
  misc_feature (30)..(31): n equals a,t,g, or c
acggcggggcggaaaagggaatcttcttannaggactctgaggtaccgcccggaattcccgggtcgacccacgcgtccgcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgataacccggaccctggtggctgcccgagccttttgtgcaaggcctggagactggaagaaatgtggtcaagcgaarccgcttaaggttggagggggcctgagtatggcagggcccagggagggaagaaggttggaaatgagaagaagaacccca

SEQ ID NO: 5020 - DNA, 2329 bp, Homo sapiens; identical to SEQ ID NO: 2631

SEQ ID NO: 5021 - DNA, 1929 bp, Homo sapiens
  misc_feature (2)..(2): n equals a,t,g, or c
  misc_feature (792)..(792): n equals a,t,g, or c
  misc_feature (1927)..(1929): n equals a,t,g, or c
anaattttgcaaaaagctatttaggtgacactatagaaggtacgcctgcaggyaccggtccggaattcccgggtcgacccacgcgtccgcaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgkaatcttaagaacacacacagatagktttattctttcagaaacaaaatatatataggatgcttarctgagaacatcatcttctttcattgcttcargtcctggttagatgaccnaaaaatgktttcagatcaccttgkgkcttactcttgagtttcttasaatatttataattataaggctgaagactaaagtgttctttccttttaactatagccagtacctgtcttgatcttagttgtgttttttttttcattttgttacccacttgcattttgttttcactcagcagaaattctccttctctgttttccttttatcccatccccaagaatgtggaaggaaggtgagaaacatggcaggatgggaaataggagagtatgactctctatagctcatccaggagtaatcaattaagaagataaattggatgactgtggagaagctctgtgataggaacacttcagtgtggttgctgagaggagacagtcattgaggtagaaggtttgccaragatccagagctcagagctccctttgtgctctttgggaattaccttgcattcagtttagaaacatggatctaaaagttactgggaaataagcagatggagacacactctgttgtttacgtattggaagaagggaacaagccagttttgttagaggtaacycattttccatgaccmaacagactcmacagattcmagtactctgcttactctaattgactagactctaggttttatttgacatcatagcattacataaatcactctgataacataagtgcacagtaatatgcctgatctcttcctttttaaaagccaacttgagttcagtaccatctgaatacacacacatgcacatatacccacacacgcatacacacmtactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcattaaaaaaaaannn

SEQ ID NO: 5022 - DNA, 1811 bp, Homo sapiens
  misc_feature (3)..(3): n equals a,t,g, or c
gcntcacacacactttggggccgactacgactggttcttcatcatgcargatgacacatatgtgcaggccccccgsctggcagcccttgctggscacctcagcatcaaccaakacctrtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaaaaaaaaaaaaaaaaaaaaaaaaaaaaaaaaa

SEQ ID NO: 5023 - DNA, 984 bp, Homo sapiens
  misc_feature (957)..(957): n equals a,t,g, or c
  misc_feature (973)..(973): n equals a,t,g, or c
  misc_feature (976)..(976): n equals a,t,g, or c
gacgaagcgtgcgcgctttggtaaccggctagaaatcccgcacgcgcgcctgcctcctctccccaggcctgagctgcccctcccactgcctttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatggaattctcctggctggagacgcgctgggcgcggcccttttacctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagttgttgtatcacagtgacatatttttcaaattcagccntcagggttaccgtttnccngagttaag

SEQ ID NO: 5024 - DNA, 982 bp, Homo sapiens
  misc_feature (955)..(955): n equals a,t,g, or c
  misc_feature (971)..(971): n equals a,t,g, or c
  misc_feature (974)..(974): n equals a,t,g, or c
gacgaagcgtgcgcgctttggtaaccggctagaaatcccgcacgcgcgcctgcctcctctccccaggcctgagctgcccctcccactgcctttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatggaattctcctggctggagacgcgctgggcgcggcccttttacctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatattgaactcagcaaawtcatatttcaccgttgtacagttgttgtatcacagtgacatatttttcaaattcagccntcagggttaccgtttnccngagttaag

SEQ ID NO: 5025 - DNA, 1069 bp, Homo sapiens
cccacgcgtccgttccgctttttttttttttttcacaggcaagtgtttattgattgcagagagggatggtctatagagctcacacccatactcccagctgggacccagccttccctgatggctgccatccaagtcttcactgggagacaggagagctgggtttccacaaggaggctggagtaagcacaagggcatccttggtcagtgaggactcagctgcctcgaatcccaaggccttcaccaatgacactgggaccccagatcttaatttgccattctggttcggcagcaggatcaaggaactgcattgggcaggagtttgccatgattgagttaaaggtaaccattgccttgattctgctccacttcagagtgactccagaccccaccaggcctcttacttyccccaaccattttatcctcaagccmaagaatgggatgtattkgcmcctgargaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattccttaaaaaaaaaaaaaaaaggg

SEQ ID NO: 5026 - DNA, 2883 bp, Homo sapiens
ccacgcgtccgaaagacttctttactctgctacagtatttctcacacaggtgaagcttagacataaaagacatgaaagtctcctaatatataatatattggctgaaaatgtgatgatgtggagattcttgtattcttgactgtgactctctatgtgttccatgttttgtgaaagattgttacttttgtgtcattgtcaactatcaatcgctgtgttcatgtattgggttcatgttacccacctatcttctgtgaggagaataaactatgtttttttaatttataaaaaaggaatgcagctgccctcttggtacccaagttcttgtccagcatctaggaagaatcaggtcacaggaatgaatggaagggtggtgaatgtggaggattttattgagcagtggaagtggctctcagtggggtggggagctagaaaggggctggagtgggaagatgatctttacctggagtttggccatccttagccaaactgttctccaaagtcctgctatcaagccgtccctctgaagtcaagctgcttctctctgatgtccagttgcttcttctcttctctccttctctgttgctctgctctgccactcagctgctctgcttctctgccacccctctgccaggggagactggggttcttatgggtacaggattgggggggcgggtgggccaaaaacaacatttgagcaggaaaatagtaatgcatgttctcactttgggccacagtcccaggcttcagggtgtggccctcactggggactgcccttttctagtcagtatttccatgcctcctgtccatatcactaatattttggggatttattcaaaatgcatggataggagaccctctttaactattacaggttaatacaaatgctctcttggcaggtttaggtgagagaaatgccttattttctactgtcttggagatctcaagatcatcatgcagacttcagagataaaaagaaaagaggctactctagtgtgaaatcttatatttacattcctcatcactcactgagaaccttagcaaatatgatttaacacgtaatatttatctgaatatttctccatctcaggagattagaagtagcaagctatgtgagaaaagggaaaggaagaagtgataagcagattagggaaagtttgagaaaacctattaaggaagatgaagagagtgagttaacgtgatatttgcaatatgtatcacttataaacaataactactgcttgattaattaaaaacatataaaccaaaaaaaggaatgctaatgaacattaaagatatatttacactgataagatctcgctattttctcttttctaaaacttccaaagactagccattgtttcataaacaaaaaatgtaagtaccttagagagacacagctcctcaggactagcccatataatagagataaagcagggcccagtacttaagagcaagctgtgaaaatagccccagtttgagcctaggcgctaccagtttcctactgagtaaacttggccaagtcacaggatctttctgcatctcagtttcctcatctgtataatgggaaaagtaatagtactatgacataaagttatgtgaagattaaatgatttattatacttaaggtcttagaccagtgttgggtgcatagttaatattcaaatgtcagctactactctttcctctcctgtaagaactcccagctgcctcatctactactctatgtgtgagcccgaactgcttttcatcagtgctagtctgtacttatcatttctttctgacacacatgtattattttaaaactcagtaaaaatatagacttttctaaaaaggctttatttgattaaatcttcatctctataatggaaactttatctgcattttttgaatcttatgtcttttctatatttttcacatttttttacagtataaagaaacccttctaatacatttcttgctcaactactattgtttctgctattactaactcctgctgctgcttgctgctggctaccatttcttgggagcttactctgtcaggcactgtgccaagtgcttcatatgcattatccactttaaatcttataaaaacttcaggaggttagtactattcattcatttaaatcatgtttattcagggcttactttgtgcatgtcaatgttctggacaccgaggatatattaatactagtgagcaaaacaaagttcctatctttgtagaaacttcattctgttgctcccattttaagaaggtatctgagtcttgcgcagttcacagagtgaaagaggtattagccaggcccaaggctattgattctaggtcccatacacagccaccctttcaaggtgtcattgtgaaattttagttttctttccgtttctattttctccttttccttcccaacatcttccatttcctgtttggagatccatagggttccaaggaaattgattctatcttagctccagggatggagaatgtgacctagtctaagggaaaataccccatgactttaactctgcagaccacagggactggttcaggggtacaaatgtgacccaagctggtcagtgaatccactttccttggattgagggacaaaagtactctttcttccggtggatagcgtaacgtttgtatatgaagcctgaaacttctatagtcaattttgcctctatgagagaagccagtgtgaaaatcaagtcaattcatggaggaaggcaaaaccaagagaatttcagagaaaagaaattagagctctaatgacattatgaacttctcgttcaaactatgcctaaagctcctgtatttctgtacttgtaagaatcacaaggcaataaactccttttatttttaaaaaaaaaaaaaaaaaaaaaaaaaaa

SEQ ID NO: 5027 - DNA, 601 bp, Homo sapiens
  misc_feature (535)..(535): n equals a,t,g, or c
  misc_feature (570)..(570): n equals a,t,g, or c
  misc_feature (579)..(579): n equals a,t,g, or c
  misc_feature (584)..(584): n equals a,t,g, or c
  misc_feature (601)..(601): n equals a,t,g, or c
tctgcagaccaagaagttaaaaaaaaaaaacagttggcaagtcactcctgaaagctaaagacttctttactctgctacagtatttctcacacaggtgaagcttagacataaaagacatgaaagtctcctaatatataatatattggctgaaaatgtgatgatgtggagattcttgtattcttgactgtgactctctatgtgttccatgttttgtgaaagattgttacttttgtgtcattgtcaactatcaatcgctgtgttcatgtattgggttcatgttacccacctatcttctgtgaggagaataaactatgkttttttaatttataaaaaaggaatgcagctgccctcttggtacccaagttcttgtccagcatctaggaagaatcaggtcacaggaatgaatggaagggtggtgaatgtggaggattttattgagcagtggaagtggctctcagtggggtggggagctagaaaggggctggagtgggaagatgatctttacctggagtttggccatccttagccaaactgntctccaaagtcctgctatcaagccgccctctgaantcaagctgnttctntctgatggtccagttgn

SEQ ID NO: 5028 - DNA, 552 bp, Homo sapiens
ccacgcgtccggtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaaaaaaaaaaaaaaaaaaaaaaaaaaaaaaaaaaaaaaaaaaaaaaaaaaaaaaaaaaaaaaaaaaaaaaa

SEQ ID NO: 5029 - DNA, 2316 bp, Homo sapiens
  misc_feature (1)..(1): n equals a,t,g, or c
  misc_feature (1230)..(1230): n equals a,t,g, or c
  misc_feature (1367)..(1367): n equals a,t,g, or c
  misc_feature (1401)..(1401): n equals a,t,g, or c
nttcggcacagggtagaatggaactgttcttccacaccctcacccaaattgtactgtccaccaatattttgaagaattcatttacccaaaacattcatttttgtttgtgactttttttttaggagaaaaagraaacmggtttaatttttcyacattaaagtcccttttycctttttaawgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgargtaggcagatcaccgagcccaaganttcaagacaatcctggccacggsgaaactctgtctctacaaaaaatatacaggcgtgttaacatgtgcctgtaatcccagcttcttgggaagctgargcacaagaattgcctgaacccaggaggtggaggttgcagngagctgggatcgcgccattgcactccagcctggntgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttgggaaatcgaggcgagtggatcacttgagctcgggagttcagggccagcctgggcaacatggcaaaaccccgtttctacagaaaatgcaaaaattggctgggcgtggtggcacccgcctgtggtccagctacttgaggctgagatgggaggatgagggaggtcggggctgcagtgagccgagatcacgccactgcactccagcaccctgggcgacagagtgagaccctgtctcaaaaaaaaaaaaaaaaaaaagggcggccgc

SEQ ID NO: 5030 - DNA, 1308 bp, Homo sapiens
ttggtacgcctgcaggtaccggtccggaattcccgggtcgacccacgmgkccgaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagactgtctcttatgcacatctcaacctgcaggggggggaagtgcttc

SEQ ID NO: 5031 - DNA, 2040 bp, Homo sapiens
  misc_feature (2027)..(2027): n equals a,t,g, or c
cggctgataagtcgttcctttttctggaatgttgcccccaggggctgaaaaggcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcytacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacaaaaaaaaaaaaaaaaaaaaaaaaaaaaaaaaaaaaaaggaaaaaaggggggaaaaaanaaaaaaaaagggg

SEQ ID NO: 5032 - DNA, 1281 bp, Homo sapiens
  misc_feature (1265)..(1265): n equals a,t,g, or c
agaatatgagaagttaaaccagggaccatgccagaaggttctctcactgatcccmcaagtacagtytacagaaaactaccttgactccactcctccagaaccccttcaccctgtggcactggctgggcaccttgtttgtcttcattgggaccttaatgtacacagaggtgtggaacaacctagggaccacaaaaagtgagcctcagaaggacagcaagaagaactgaggcctgtctggagtacgtagaccagtgtcgtcgtgagggtgggaccctgtgaaggtctgaccaccgtttcgcttttgttaatgccgagctacccgcagtgctgagccagccgtgcaaaaggaaatcttcaggaggggacttctcacgttgctcagactgacacatgtagactaaatagaaacccctcagccctaaaatagaaaaaagaacagttctggactattgaacagcccattcatttatttctgttttgtttaccgacatattcagtattattcttgttttctgaattctgagtctcctgaacaaaaggctkactatccatggtcttggaaaagattgtcccttctyttgctgttstaatgcatctytgctacagcagtcattgtcatcctgtgaccttatcccttttgtytcccatcaccttttccttcttcagcagcacctcacagtcagtcagacgctgcaggcaccactatcaccaggagtggccaagtaaaccgagacaccagtaacagcagggctggacttcctccagcgttttgggaaggaaagagatgttcccctgagctgattcccagtgacagtgcagcaagactagtgggactcctctttcccacattttgcttttttttttttctatgcaaaagtcagatgcttctatccattgctttctgtgattagggcggccctgcagcatatctcacagcagacacagtgttcataacaaagaaaggttgtgccgggcacggtggctcacacctgtaatcccagccctttgggaggctgaggtgggtgtatcacttgaggtcaggagttcaagaccaatctggccaacatggtgaaaccccatctctactaaaaatacgaaaattagctgggtgtgatggcgcatgcctgtaatcccagctacttgggaggctgaggcaggagaatcacttgaacccgggagatgaaggttgcagtgagctgaggtcgtgctactgcactcccgcctgggtgacagagtgagactctatctcaaaaaaaaaaaaaaanaaaaaagggcggccgc

SEQ ID NO: 5033 - DNA, 884 bp, Homo sapiens
atcccagtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggtttttgcgagcagcttggggacattgtcagcaatgctgaaaaagcgaaagggagtatggagattgaaac

SEQ ID NO: 5034 - DNA, 839 bp, Homo sapiens
  misc_feature (772)..(772): n equals a,t,g, or c
  misc_feature (804)..(804): n equals a,t,g, or c
  misc_feature (825)..(826): n equals a,t,g, or c
  misc_feature (829)..(829): n equals a,t,g, or c
aacggaaacgcttcactatagggaatgctggtacgcctgcaggtaccggtccggaattcccggatcgacccacgcgtccgcttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgarggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaarggtcctggggagcgtccccggraaggaggcagccagccaagggctcctgaagmaggtcctyttccctcccagtgttgtccttctggaggccgctgcccggaaatgactggaagaagtccgccattccttgggagtgggtcaccctgattggccaacgagacgcctacggcctncacatgtgcattgatgattcgagaatgtgcanactcctgagtgggcacatatnnttnaataatctga

SEQ ID NO: 5035 - DNA, 1312 bp, Homo sapiens
  misc_feature (1306)..(1306): n equals a,t,g, or c
gcggctggatttaaggttgcgctaccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggargargaggargaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaaaaaaaaaaaaanactcga

SEQ ID NO: 5036 - DNA, 1597 bp, Homo sapiens
  misc_feature (381)..(381): n equals a,t,g, or c
  misc_feature (591)..(591): n equals a,t,g, or c
ggaggccgctgcccgaaatgacctggaagaagtccgccagttccttgggagtggggtcagccctgactkggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgmtcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgnccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggnctactggggccaggtgcctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatggaaaaaaaaaaaaaaaaaaaaaa

SEQ ID NO: 5037 - DNA, 1315 bp, Homo sapiens
ggcacgagcgctaccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggagagaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgatccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaaaaaaaaaaaaaaaaaaaaaaaaaaaaaaaaaaaaa

SEQ ID NO: 5038 - DNA, 1051 bp, Homo sapiens
  misc_feature (1039)..(1039): n equals a,t,g, or c
  misc_feature (1043)..(1043): n equals a,t,g, or c
  misc_feature (1051)..(1051): n equals a,t,g, or c
ggcacgagagtcaatactgcactttctgatggagtcttaaggagtcacagtatttataaccattttgagctaataagctatacctcactctctgctttctctctcwctctttttgatagtgtgttagggtgaaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgttwgtagtaaggaccgtaacccaccccttcctccccccaaaactatactgttatttttctatgtaagcaaattgtttgaaatgctttgaaaatgaaatcttaatattaaaaggcatatgcatgtaaaaaaanaaanaaagggcn

SEQ ID NO: 5039 - DNA, 1048 bp, Homo sapiens
  misc_feature (1040)..(1040): n equals a,t,g, or c
  misc_feature (1048)..(1048): n equals a,t,g, or c
ggcacgagagtcaatactgcactttctgatggagtcttaaggagtcacagtatttataaccattttgagctaataagctatacctcactctctgctttctctctcwctctttttgatagtgtgttagggtgaaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgttwgtagtaaggaccgtaacccaccccttcctccccccaaaactatactgttatttttctatgtaagcaaattgtttgaaatgctttgaaaatgaaatcttaatattaaaaggcatatgcatgtaaaaaaaanaaagggcn

SEQ ID NO: 5040 - DNA, 1606 bp, Homo sapiens
  misc_feature (451)..(451): n equals a,t,g, or c
  misc_feature (1586)..(1586): n equals a,t,g, or c
  misc_feature (1598)..(1598): n equals a,t,g, or c
  misc_feature (1601)..(1601): n equals a,t,g, or c
ctggackcctgcargtayygyccggaattcccgggtcgacccacgcgtccggttcatacaagtcaatttaaaaatctattaagttctaataaataagtgaacagaagttcacgtcacaaaatatagtaaacaaatagatggaaaaactttagttttgctaacaataaagaaatgtgaagttaagataagggcatcttcctttttcctcatttatgtttgccaaaaaatttaaaagcatgatacttattatgagtatggattcagtgaaattggtactgggatggccactctgggtcctatgcttttggcaggcagcctggtgttttaaaaaggcttttgaatggcaacagactttaccattatattctacagaaatggtaaataagccatgatttttattttatatattcagatatacgtgtgaatgttaattgctttgtgccttcgctgnttttagaacagccttctttcataccttactggtgatgtattaatagcaccattttggaatgcagtttggtatagtatgtttcaagaatcataggattcttgtctttttttgaattccgagtcccatttctgagattctctactaaggaagtaataaaaagtatagtaacaactatatccttaaaaatggcctatataacaaataaatagactctaaatgccctattaaaggaaagtggagccaggtatgattacttgcatgcctgtaatctcggcctcccaaagtgctgggattacaggcatgagccaccgcccctggcctccatctagactttgaaatgattgccttctaattacagtagcattctcttatttaaaatatttgytttatttaagtcagtgtttaagcaatagctcagcatatcccagtggtccagtgaccacacagctgagaacccttgttaagtggtacagtaaagcattctgtcaaaactttgacatttatgacatgttacctaggaaataggacttagaaaatgagtttgacctgggctttaaaaaagtatactgatgaaggtgccagaattgatgtccattagactgtaagctccatgggggcaggaactttgctaccgaatctatacaaccttaacattgactagtgcttgtaggtgtgctcaatacttgkttgttaactgaatcaaaaggagtaaatgcacaatatttgaacattgtatccaaaggaagaaacctgcgaaataaaattatttgcagaaatgaacatttgttgaaatgcagaaaaccactggatactgcagcctacaatattaatatgatattactcttttacagttgacacctgtcctctctgtagtctcttctctcaaatttggttcttattgagagcctgtctagtttcccaaaggttttataaaacataagttgaagtacctttatttttaattttatttttgagacgggacctcgctctgtcaccgaggctggagtgcagtggcataatcatggctcactgcagcctcgtcctcccgggctccatccatctgcccatctctccctctgrgtggctgggaccacgggcgcgtgccaccacacccagctaattttkgtatgtttgnkaragagggctnttnaccca

SEQ ID NO: 5041 - DNA, 594 bp, Homo sapiens
  misc_feature (102)..(102): n equals a,t,g, or c
  misc_feature (134)..(134): n equals a,t,g, or c
  misc_feature (165)..(165): n equals a,t,g, or c
  misc_feature (187)..(187): n equals a,t,g, or c
aacttctggctgggtgtggtggctcatgcctgtacccccagcactttaggaggccaaggcaggtgaatcacctgaggtcaggacttagagaccagcctgacnaacatggtgaaaccccatctctactaaatgcnaaaattggctgggcatggtggcgggcgcctntaatcccagctactcaggaggntgaggcaggaggattgcttragcccggraggcggaagttgcagtgagccgagactgcgccattgcactccagcttgggtgacagagcgagactccgtctcaaaaaaaaaaaaaaaaacttctgaggtaggggctgtaccatatttttgccccacacccattaagcgaataccaaaaacaacttgtggaaatttgataattttatcaaatttattatttgggcaggattggcatttaccatgcttttccctattgctggcagtaaaacatgggtttaaggaagagtgtttttcagaatttacactgtatatctctgatttggaagttatataattggaatttatgattatgagattaaaataccaaaaagactaagtaaaaaaaaaaaaaaaaaaaagggcgggccgc

SEQ ID NO: 5042 - DNA, 1660 bp, Homo sapiens
ccgggtcgacccacgcgtccggcccgcggaaggcgacatgggctccgctccctgggccccggtcctgctgctggcgctcgggctgcgcggcctccaggcgggggcccgcagcggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggactggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctatctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttcccggacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggccatgtaaaaaaaaaaaaaaaaaaaaaaaaaaaaaaaaaaaaaaaaaaa

SEQ ID NO: 5043 - DNA, 1220 bp, Homo sapiens
  misc_feature (341)..(341): n equals a,t,g, or c
catgaatggctcgcacaaggaccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcantgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcaragcaatccactactgccagaccagaaggtctgctaaaaggtcagagtaatgcagaatgcgtgccttcatctcagatttgttcatcacaggtggatcccatgtktcttcagtagacaagtcacctttgtagctagcaccagtgccagctccatgccattgcaccttctttagtcttgattgcccttcccgcatttwttggtgtattaaaatgactratkaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaaraaaaaaaaaaaaaaaaaaaaaaaaaaactcgagggggggcccgtacccaatcgccct

SEQ ID NO: 5044 - DNA, 925 bp, Homo sapiens
  misc_feature (444)..(444): n equals a,t,g, or c
ctgcaggaattcggcacgagcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacngccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaatattaatagtactcatgcatcagtttatgag

SEQ ID NO: 5045 - DNA, 1569 bp, Homo sapiens
  misc_feature (823)..(823): n equals a,t,g, or c
  misc_feature (847)..(847): n equals a,t,g, or c
  misc_feature (1328)..(1328): n equals a,t,g, or c
  misc_feature (1434)..(1434): n equals a,t,g, or c
  misc_feature (1453)..(1453): n equals a,t,g, or c
  misc_feature (1462)..(1462): n equals a,t,g, or c
gggcatttccgtcattattattattgctgaatagtattttattatataccatattttatccatttacgtgttgatggacctttggactacttcctttttcttttttgcagtgatgcataatgctgctatgaacataaacgtgcaagtctctgaaagtggcttttcattttggggtagatacctaggagtggagttgctgggttgtgtggtaaatttatatttatttaagaaatggccaaactgttttctaaatggctgtatcattttacatccccatcaacaatatattagggtttcctgtttctccacatcctatttgttaatggcttttaaaaattatagacattcttgtaaatgtgaagtagtgtctcattgtagttttagtttgcattttcctaataacaatgatgtttaacttttttgtgtgtgcttattagctgtttcacatgcccttatacatattccattttttacttactgtttccataaatcactgcatgtaaattcagagctctctctctgtctcactttctcttttgttgtattccatggcatgtaggtgccatagttttttctgatcaatctgctatctatgggcatttaagtagtttttaatattttaccaaaatacaaaatgctacaatgaatcgtcttacatatgtatttatgtttaaggtatttcttcagactacagtccttgaatactaagtcaaagtatatatgcatgtgtagtttgttggatattgcctttccataaaggttgtggcatttcagattctaccagcaatgcgtgagactgttttcccacaacttcactaacagngacatactgtaaagcttttgaagntctgccaatctgataggtgggaagtaatatctcattattgctttaatttgcatattatgaatgaagttaaacatcttcaaggactatttttctattttttgtgattgtgcctttgyttatggtgttactttgccatgcaaagtttttatttattttttggtagtcaaattgattaactctcctgtgaaaccatctgagtttggtggtttttgggaattaatttcttgataacattatttcttatatttaaattgatttcttttaagttttttggcttaaaggggtcagtttgctaaactgtatatttttaagaaattatccatttccttttagttttcaaatgtatttccactgaagtaatcttttaaaaaaattccctatatcaatagttatttctcccttgttattttttattctatctgcactttctcccttttttcaaaaaattaaactagcaagtcatttgttttattgytttggnttttttcaggacttttctcattaatttgatgtactgtttttctattktctatctcaatttctgttctaatattttcttctttggacttttttgtattttactttgntgttctggktctttcaagntaagaattnacatcttatttatacaggtatttaggctatgatttttttctgattactgcttagaatgtatctcgtagatatatttattaccattatttttcagaaattatgtaatt

SEQ ID NO: 5046 - DNA, 409 bp, Homo sapiens
  misc_feature (352)..(352): n equals a,t,g, or c
gggcatttccgtcattattattattgctgaatagtattttattatataccatattttatccatttacgtgttgatggacctttggactacttcctttttcttttttgcagtgatgcataatgctgctatgaacataaacgtgcaagtctctgaaagtggcttttcattttggggtagatacctaggagtggagttgctgggttgtgtggtaaatttatatttatttaagaaatggccaaactgttttctaaatggctgtatcattttacatccccatcaacaatatattagggtttcctgtttctccacatcctatttgttaatggcttttaaaaattatagacattcttgnaaatgtgaagtagygcctcattgtagtttagyttgcaytttcctaataacaatgatg

SEQ ID NO: 5047 - DNA, 504 bp, Homo sapiens
  misc_feature (351)..(351): n equals a,t,g, or c
  misc_feature (361)..(361): n equals a,t,g, or c
  misc_feature (388)..(388): n equals a,t,g, or c
  misc_feature (482)..(483): n equals a,t,g, or c
ggcacataatgcagggcctgacacatccgtagagtccttggaaaatgtcactgctattgctgctgtctgtactaatgtcacctggggctaggccctcagaccctgtggaggtgattgccagtggccccaccgtggccagttcccacaatgtgcaagattgcctgcatatcctcaatcgctacggcctccgtgcagccctgccacgttctgtgaagactgtgctgtctcggkccgactctgacccccatgggccacacacctgtrgccatgtcctgaatgtgatcattggctctaatgtgctggcgctagctgaggcccagcggcaggccgaggcactgggctacaagctgnggtgctgaantgaaccatgcaaggtgatggaaaaagnatggcccaagtttacggctgttgcccatgtggctagaacccgctacccatcatggctggggttctgggaggaaatgcacagttcatgactgganntgacttagatccagacttgag

SEQ ID NO: 5048 - DNA, 440 bp, Homo sapiens
caggtattcgagggtgcggaggacaacctcccagaccacgatgcgctgcgggctgcactggccatccagcaactggctgagggactcccagctgatgacctgctgctcgtgctgatctcagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggtta

SEQ ID NO: 5049 - DNA, 1323 bp, Homo sapiens
  misc_feature (24)..(24): n equals a,t,g, or c
tcccgggtcgacccacgcgaaccncggacgcgtggggccgkctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcrgagctgttgctcatgctggagtctccagaatccctccatgccaagatagacgaggcagtggccgtgctgcaggcacaccaggctatggagcagccgaaggcgtacatgcactgaaaccagatttcagcttaaaatgccacccagagaccaagttcattctgtcaactgatctccagcacctggcccagagacggaaagtacaaagactagtaaaatacatccttgcccttaaggagctaagtacccaaaacctgtaatccatcttgagtcaccagagtacggttgctcagaaacagcagtggtgcggtggaaagggcatcaaccctgcgatccggacaagtcactccatccctctgatcatgcgtgcccacctaccacatgaggatatcacttcatagacttgctggaagggttcattgtgttagcctgttccctgagctctcttcgtgatcaagaagactgatcagataaatcaagagacttgcccaaaattacctaggaaatctgtagcagcagcagaaccaaactccggtccttgctaaatctagataccaggctagcttttctatggacccagaattaacccatacaaatgtacaagcttttccagaccagctggggtgagatgaatgaaaatggcagcaacatcaatacctcagcttcttcagcaacttcatcaagtaaggctgccatgaggaagtgggcctaaaggagagttttctagaacaaagaagggggcaaaggagtggcttgaaactgcaaaaagtgcagacaaaaaaaaaaaaaaaaagaatgaaatctggagaggatgtgaggagaggtctagcaaaatgattaaaaatttggacttagcatcaaagtcaaacagatccatattcaaatcgtgggctcttccatgtcttcactatgtaaccccgaggggagccaatttaactctcttggactcctcctttctaagcattttatccacagggccataataaagatcaaaggagatcgtgtctaaaaaaaaaaaaaaaaaaaaaagaattc

SEQ ID NO: 5050 - DNA, 739 bp, Homo sapiens
gaattcggcacgaggggagtaaggcggactgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccamccccagccccggtcaatgggtcagtctttattgcsctgcttcraagattcgactgmaactttracctcaaggtcctaaatgcccagaaggctggatatggtgccgctgtagtacacaatgtgaattccaatgaacttctgaacatggttttgtaacctaccaaaatggataggctgttgaacattccacattcaaaagttttgtagggtggtgggaaatgggggatcttcaatgtttattttaaaataaaataaaataagttcttgacttttaaaaaaaaaaaaaaaaaaaaaaaaaaaaaaaaaaaaaaaaactcgaa

SEQ ID NO: 5051 - DNA, 1529 bp, Homo sapiens
  misc_feature (7)..(7): n equals a,t,g, or c
gggcacnagatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggacaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgagtaaaaaaacggatttcctcttcctagcttaaaatctgatttacactgttttgttttttaagaaacaaaagtgcatagtttagattttttttttgttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccrctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactaaaa

SEQ ID NO: 5052 - DNA, 539 bp, Homo sapiens
ggtgcactgttactccatacggatggtatctgctttatgtgtttgacaacggcaggtttttgtytgcttgccatacattcatttgcacttggagtgcaatccagacagcagcattctgtccccattgtytttgaggtcctgccactcagagtccccgagccaagcagggtgacagggtgctcttcattttttcaaaccaaagttctttgcaagcagcatctccttgggccgagggcttcagtgaatattgtcctggcctgcctggcctgctgccaccgtaaaggcctttgtgtccacataccagccaacctgatgtccccatcctcagcaaagctttatcacagcctccactgacaaccgaagcctaagccactgaagaaatcatagatgccatgagagaatcatagataccaccattgatgacagtaaaagaaatcatacagagacracacatctggaacccacctagaatcaaatccagagcaccctacccagctaacatacagctacatctacagtaaaagtcttttctctacaaa

SEQ ID NO: 5053 - DNA, 1198 bp, Homo sapiens
agaacaggtctttcctgttytctggacctgctagaaagcttcagtcagtttggtccctgggagagaaaacgctcttcccatgacggctctgtggaggccaggaatggggtaggtggsttgactgggagtactccttcctgccgccctggtcaagggactagygtgagtcgggagtgcatttttggaatgggggcaggggtgtttttcatgaccatttatttgagtggttttgattggttatgcatactctttaaatttgaatccaaattttttgcaaaattacttcccaatcagatcttgacccttagcctgggacaccacaaactgaggtgaattctctgctttgctcgtcacaaatgccaaactgactgccctttcacggtgtccatcttgctgtcttttgcttctgtttgatttggtctgcatatcttttaatgtgtctgtttttgttttgtttgttttatttttatttttcagttaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacaaaaaaaaaaaaaaaasctccgggggggggccccggtccc

SEQ ID NO: 5054 - DNA, 731 bp, Homo sapiens
  misc_feature (642)..(642): n equals a,t,g, or c
  misc_feature (657)..(658): n equals a,t,g, or c
  misc_feature (667)..(667): n equals a,t,g, or c
  misc_feature (713)..(713): n equals a,t,g, or c
  misc_feature (717)..(717): n equals a,t,g, or c
  misc_feature (727)..(727): n equals a,t,g, or c
ggtttttgtgtagatcttggatggaaacgcaagggtgatggggttggtgtagcagcagctaggcttaagaaacgtttggagggcacccccccccctttttttcctcttgagttttaagctttactccagccttgggarttgatttaacctttatccctggcacttggaggaraaaacagtgtaagcttttaacattttttgcccactcagtgctcacttttagtaatatttggactctttctcctcctatctcaggaaagaacaaaaacaaaagacatcaccttggatgtatcccccaacccccaactttagccaaaattgccaaagcagccaagggatcagcaggtgaactctcccagcattggatctatcattctcaaatctcgctgacaacttttatctctcataacaaaaagcagcttacctactgtttcatattatgaataattccatagctgcccaggcatcaaagtttgtgatactctacctattcatcctttcttttcccaaacagtgcatttgccatattttaagtgagatggtctggtaaatcccacttctgacaccacttttttcaagtgtcctcaagacccttgccaggttcaagggattcccttaaaagaactcacaggactcaacggnggaagtttaaagctnngacttaccnggaaaagggattcgaacaaaatcagcaaaagggaaaagggttcaanggantggaaacccnaaag

SEQ ID NO: 5055 - DNA, 692 bp, Homo sapiens
  misc_feature (5)..(6): n equals a,t,g, or c
ttttnncaaaaaagcttatttttaggttgacacttattagaagttacgccttgcaggttaccggttccggaattcccgggtcgaaccccaaggggttcgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggcaaaaaaaaaaaaaaaa

SEQ ID NO: 5056 - DNA, 981 bp, Homo sapiens
cacaagcttccaagagtcttcttccccatggaatccatacaatacttaatgtaatttacataaatttaaccagtgttggaattatgacaatgtgtatgaaatgtaatctgccaaagaagttccttagagactcggtgtccaaggttttgattgacagctggtcacataggtaccttctaactagcatgtaccaatattccagactttctgaagaaaagcaggtgattagcatatactgcattatttatacaaacaatttgggcactttgaaggactcctatcagttagggtggtgggaaccctcctgaaatccaagttcccagacaccagccatggatcaaccttgcaagaggcttttctaaggatagccatctgaagcctgctatgttaactcttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgraaatatatccgatctaattaaattaggtcagcctgca

SEQ ID NO: 5057 - DNA, 2880 bp, Homo sapiens
ggcacgaggaaaattccgtattgcgaatcattcgcaatacgcatacgatggcgcccgccgggatcgcccggtcccggccgcgagagtccgtcatgtcgttccgcccgatcgctgcgttgttgctggccgcgctctacgcgagcctggaccggaccgccaccccgatgtacgacggcgccgacacattgagcgtccgcgttttcgaaccgtaaccgtcctttctccaggggaaccaccatgaagatcgtcccgctcaccgcggccgtgctggcgctggtgctggcgccggccgcccatgcgcagccggccaacaaggccaccactgtttcgccgaccgccgccgccttcctggcgcagttcgccaccgagggcaacgacagcgtcagctgggcccagttcgaggccttccgcaagcagcgctacgccgacaccgaccgcaaccaggacggccacgtcgacgaacaggaatacgtcgacgaatacctgcagcgcttcgacgtgcggctggccgatgcacgcgccggccacctgcgccagaccgacacccgtttcaaggcactggaccgcgacggcaatggggcgatcagccgcgccgaatacgatgccgctggcgaacgcacctgggccggctacgagcggtcgcagaacgccacgcaggagactgctgcggcgtcctcgcgcgatccgctgaagatgccgacctcgcataccgccaacggcatgttggacctgtacgaccgcaacaaggatggcgcggtggatcgcgaggagttcgacgcggtgcgcgcagcgagcttcgccgccaccgacaccgacggcaacggcacgctgtcgttggccgagtacaccgccgaattcgaaggccgcctggaccagcagcgccagcgcgtgcgcgccgatgccgagcgccaggcacgcgtgcgcttcgcctcgctggacaaggacaccgatggccgcatgacgttcgccgagtaccagctctcgggcaagcgcatgttcgaccgtgccgacagcaatggcgatggcgtcgtcgacgcacgcgatcccgagccggtcgccggcgcgcactcggccaacggcaaccgctagcgccccggacgtgccgcgcacgtcccacgtatcagccaacgatgaatccggcgcgtggtttcccgcgcgcccttgcgcctcccagccccgctcgatccaccgatcgccgcagccaggaacggcccgccgccaccgcggcgttcacgccattcccttttcctcctgcggagtctgatcatgaagtcgtccctcaccctgctggccatggcggtcgccgccagcctgtccttcaccgtgcacgctgaaaccgctgccgacgccagcacgctcgataccgtgcgcgtgcaggccgagcgcgccaagaaaacacgctcggccaaccagaacgtcaccgtgctgaccgcggccgatctcgacaacgagatggccaacacgatggaagaagccatccgctacatccccggcgtcagcatcgtggacatgggccgcttcggcgacaacggcttcaacatccgcggcctggaaagcgaccgcgtggcgatcaccgtcgatggcctgagcctgggcgaatcggtggaaaccgcgcgttcctatgagttcttccgcggtggccgcggcgatgtggacatcgatacgctcaagagcctggccgtgatcaagggtgccgactcgatcagcgccggcagcggcgcgctcggtggcgcggtggtgttcaccaccaaggacccggccgattacctcaagcccgccggcaatgacacccacctgggcttcaaggcgggctactcgggtgccaacgacgaaaccatgggcacgctcaccttcgccaaccgcaccggcatcgtcgaatcgatgctggtctacacccgccgcgaaggccatgaatccgagtcgtggtatgacaccacgaacgaccgcatcggggtcggccgccgcacgccggacccggtcgacagcacgcgcgacaacctgctcggcaagctcgacctgcagctggacgaggccaacacgctgggcttcctttacgagcgcggccgcgccaccaacgacgtggacaacctgtcgcgtgtctatgcgccgggttatctgtcgcgcaaaggccatgacaccaacgaccgtgaccgctacggggtgaactaccagtggcgcgccgacaccgcgctgttcgatacgctggatgcgcaggtggaccgccaggtcactgacagccgtggcatcaccaccatcgtggccggcagcggctgtcccggcggcgccacgccgtgcctgcgcagcgagaaccgctcgaccaagcagaccctggaccgtgccgcggccgacttcagcaaggtgttcgccaccgcaggcgcgcgccatgatgtggtctacggcctggcctggcagcagcgcgacatcgatttcaccgccgtcgatacgcgctggaatgccgccggtgccatcgcgtcggtggaaatcgatccgcgccaggtacccaagaccgatgtgaccgcctggaacctgtacctgcgcgacagcgtgcagctgctggacgaacggctgaccctcagtgccggcgcacgctatgaccgctacgactattcgccgcaggtggatgccaccttcgtggatcgcaccggcaccgtgcgcgatgtgagcttcgcttcgccgagctggcaggccggcgccgaataccgcttcctgcccgaccatgcgctgtgggcccaagtgggccgcggcttccgtgcgccgaccgtggcggacatgtattcgccgaccagcgcgacgcaggtgatcaacgcgcagaacggccagccgctgctgctcaacgacaccgtgtccaatccggacctggactcggaaaagagcctgaat

SEQ ID NO: 5058 - DNA, 2751 bp, Homo sapiens
  misc_feature (2642)..(2642): n equals a,t,g, or c
ggaaaattccgtattgcgaatcattcgcaatacgcatacgatggcgcccgccgggatcgcccggtcccggccgcgagagtccgtcatgtcgttccgcccgatcgctgcgttgttgctggccgcgctctacgcgagcctggaccggaccgccaccccgatgtacgacggcgccgacacattgagcgtccgcgttttcgaaccgtaaccgtcctttctccaggggaaccaccatgaagatcgtcccgctcaccgcggccgtgctggcgctggtgctggcgccggccgcccatgcgcarccggccaacaaggccaccactgtttcgccgaccgccgccgccttcctggcgcagttcgccaccgagggcaacgacagcgtcagctgggcccagttcgaggccttccgcaagcagcgctacgccgacaccgaccgcaaccaggacggccacgtcgacgaacaggaatacgtcgacgaatacctgcagcgcttcgacgtgcggctggccgatgcacgcgccggccacctgcgccagaccgacacccgtttcaaggcactggaccgcgacggcaatggggcgatcagccgcgccgaatacgatgccgctggcgaacgcacctgggccggctacgagcggtcgcagaacgccacgcaggagactgctgcggcgtcctcgcgcgatccgctgaagatgccgacctcgcataccgccaacggcatgttggacctgtacgaccgcaacaaggatggcgcggkggatcgcgaggagttcgacgcggtgcgcgcagcgagcttcgccgmcaccgacaccgacggcaacggcacgctgtcgttggccgagtacaccgycgaattcgaaggccgcctggaccagcagcgccagcgcgtgcgcgccgatgccgagcgccaggcacgcgtgcgcttcgcctcgctggacaaggacaccgatggccgcatgacgttcgccgagtaccagctctcgggcaagcgcatgttcgaccgtgccgacagcaatggcgatggcgtcgtcgacgcacgcgatcccgagccggtcgccggcgcgcactcggccaacggcaaccgctagcgccccggacgtgccgcgcacgtcccacgtatcagccaacgatgaatccggcgcgtggtttcccgcgcgcccttgcgcctcccagccccgctcgatccaccgatcgycgcagccaggaacggcccgccgccaccgcggcgttcacgccattcccttttcctcctgcggagtctgatcatgaagtcgtccctcaccctgctggccatggcggtcgccgccagcctgtccttcaccgtgcacgctgaaaccgctgccgacgccagcacgctcgataccgtgcgcgtgcaggccgagcgcgccaagaaaacacgctcggscaaccagaacgtcaccgtgctgaccgcggccgatctcgacaacgagatggccaacacgatggaagaagccatccgctacatccccggcgtcagcatcgtggacatgggccgcttcggcgacaacggcttcaacatccgcggcctggaaagcgaccgcgtggcgatcaccgtcgatggcctgagcctgggcgaatcggtggaaaccgcgcgttcctatgagttcttccgcggtggccgcggcgatgtggacatcgatacgctcaagagcctggccgtgatcaagggtgccgactcgatcagcgccggcagcggcgcgctcggtggcgcggtggtgttcaccaccaaggacccggccgattacctcaagcccgccggcaatgacacccacctgggcttcaaggcgggctactcgggtgccaacgacgaaaccatgggcacgctcaccttcgccaaccgcaccggcatcgtcgaatcgatgctggtctacacccgccgcgaaggccatgaatccgagtcgtggtatgacaccacgaacgaccgcatcggggtcggccgccgcacgccggacccggtcgacagcacgcgcgacaacctgctcggcaagctcgacctgcagctggacgaggscaacacgctgggcttcctttacgagcgcggccgcgccaccaacgacgtggacaacctgtcgcgtgtctatgcgccgggttatctgtcgcgcaaaggccatgacaccaacgaccgtgaccgctacggggtgaactaccagtggcgcgccgacaccgcgctgttcgatacgctggatgcgcaggtggaccgccaggtcactgacagccgtggcatcaccaccatcgtggccggcagcggctgtcccggcggcgccacgccgtgcctgsgcagcgagaaccgctcgaccaagcagaccctggaccgtgccgcggccgacttcagcaaggtgttcgccaccgcaggcgcgcgccatgatgtggtctacggcctggcctggcagcagcgcgacatcgatttcaccgccgtcgatacgcgctggaatgccgccggtgccatcgcgtcggtggaaatcgatccgcgccaggtacccaagaccgatgtgaccgcctggaacctgtacctgcgcgacagcgtgcagcttgctggacgaacggktgaccttagtgccggcgcacgctatgaccsgttacgactattcgcccgcaagtggatgccacctttgtggatcggaaccggnaccgtgcscgatgtgaagcttcgctttggccgarctggaaggcccgggggccgaataccsggtttcytggcccgaaccattgcscttggggggccccaagtggggcccc

SEQ ID NO: 5059 - DNA, 774 bp, Homo sapiens
  misc_feature (1)..(1): n equals a,t,g, or c
  misc_feature (13)..(13): n equals a,t,g, or c
  misc_feature (711)..(711): n equals a,t,g, or c
  misc_feature (713)..(713): n equals a,t,g, or c
  misc_feature (717)..(717): n equals a,t,g, or c
  misc_feature (740)..(740): n equals a,t,g, or c
  misc_feature (764)..(764): n equals a,t,g, or c
ncggccagtgaantgtaatacgactcactatagggcgaattssgtaccgggccccccctcgagattcaggctcttttccgagtccaggtccggattggacacggtgtcgttgagcagcagcggctggccgttctgcgcgttgatcacctgcgtcgcgctggtcggcgaatacatgtccgccacggtcggcgcacggaagccgcggcccacttgggcccacagcgcatggtcgggcaggaagcggtattcggcgccggcctgccagctcggcgaagcgaagctcacatcgcgcacggtgccggtgcgatccacgaaggtggcatccacctgcggcgaatagtcgtagcggtcatagcgtgcgccggcactgagggtcagccgttcgtccagcagctgcacgctgtcgcgcaggtacaggttccaggcggtcacatcggtcttgggtacctggcgcggatcgatttccaccgacgcgatggcaccggcggcattccagcgcgtatcgacggcggtgaaatcgatgtcgcgctgctgccaggccaggccgtagaccacatcatggcgcgcgcctgcggtggcgaacaccttgctgaagtcggccgcggcacggtccagggtctgcttggtcgagcggttctcgctgcgcaggcacggcgtgcgccgccgkgacagccgctkccggccacgatggggttttggggttggaaattngncccnaaccggggcctttggttcaaagnttggaaacccccttttggggcccngggggttccc

SEQ ID NO: 5060 - DNA, 748 bp, Homo sapiens
gcagattctcttgtttttagtaatctagtcccttcatctggtaacttacagggattttccattgagtttatatgttttcccaggatatttttggtatgtctctttttaaaaattatttgcatcttggactttggagaaccatttcaatgtaaagattcaaacctttcttttgcttagtaaagagttctatttctttaatcatcacttttctatgtgttactttttatattttgaagcccctgtccttggttggttttatctcacggatctgccatctaatttctttttaaatctcttcactttaatctatttctttgatatttgctctgtattactttccttccatttttctttcagaycgctgatttgatgcttygcagtaactctttttcaccttcattgagtgkttacctttgckcactttgkttttctttggkttctagtaaatccagcaagtaagggctctaattgtacttccttgggcatttatttaaaaaaaaaaaaatgaaagtactttatgtctttcagtagtgttgcctcaggaaagaaaccatacttgttctgattattcacaagggctttcttttagcttcctcaccycttttaaatcagktctaagttttttagggggacgagcagagctattggagttgcttggaaaatggcaatcatttagatggtaacagataccatagttgacagtgtactatgtcattagcaagcaaactggtaaaatctgggggaacat

SEQ ID NO: 5061 - DNA, 1194 bp, Homo sapiens
  misc_feature (757)..(757): n equals a,t,g, or c
  misc_feature (1009)..(1009): n equals a,t,g, or c
  misc_feature (1142)..(1142): n equals a,t,g, or c
  misc_feature (1173)..(1173): n equals a,t,g, or c
ggagttcggagcctaggagccccccgcggctgcggcgcaggtgccctcggcctgagtcgggatggagctgcctgctgtgaacctgaaggtgattctcctaggtcactggctgctgacaacctggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgcccgggccttctcgtgcctgggaggtcgttctagggatgctcctgacctycgtctcttggacctaagatggaatgtgtcccagctcarggattgcctgaaccaagargscaggarcccccatgggccgsccartaccatgcacactyctgtcccgaactccctgaggcytcccytccttcagggcacccactggttcccagctggaamcanggtctctctttamctyctaccccaggtggsaccacaraggccctcagccgaktcctgsctgagtgttgcaakctcaggcctttaaggactgctgatgccccctcaggctcccccaagtttgctgsctttggwggaagccctgagagcttcaggtcctgctcagcccgaggagcagtctggcatgggagtgaggccccgtccttctcactgcctggtcacatggtgcctagggatgcagggctggaggcagangtgtcagcaacactgtgaaccaacacaacttcagcctcccttttagagcacagcattaaagtttgggaatctgtaaaaaaaaaaaaaaaggggcgaagttattccttaggaggtaattagttggatggcgtgnttaaagtgtatggaaaaaaggtaccaattangctgagaatcctttcatggaa

SEQ ID NO: 5062 - DNA, 1218 bp, Homo sapiens
aattcggcacgagccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgacccaccacaacctccagcctcccttttcagagcacagcattaaagtttggggaattctgtaaaaaaaaaaaaaaaaaaaaaaaaaaaaaaaaaaaaaaaaaaaactcgag

SEQ ID NO: 5063 - DNA, 598 bp, Homo sapiens
  misc_feature (444)..(444): n equals a,t,g, or c
gccactgtatacccttgctctagctaaactagcagctccagctgtttcatatacatgcttctgcttttgcacatccatgtctttggtcatagtgtacctgcagcatggagtgcttcctgtgtccagatcttacctgtccttctgaggattagatcacagatacttatacatacaattttgtttgcagcctatacactagctttcctaaacttcttcctgtcacctaattatgctgtgttctgtcttgccattgtgcttttgcacacaagttcctttggtttagaatatccctccctctgtcttttctttcttaaagagacagggtctcagtgtgggctggtctcgaactcctgagctcaaatgatcctcccatctcggtctcccaaagagctgtgattacaggcgtaagctgctgcacmwrrtccttccttcctactttctgtnaaacttttacagcttcctcaggtcaattacatgctccttttcattatgctcccattgtccctttgcgtatttccacggaggcactcatcacattttattgttattgtttacatatctgtctgtcaaaaggctttgttttccaacagcagaagtt

SEQ ID NO: 5064 - DNA, 594 bp, Homo sapiens
  misc_feature (554)..(554): n equals a,t,g, or c
gtggaaactgatttgcctaggaatatacatgtgtgttttatagaaaataatgcacaaatacattcttattgtcaaagatttaaaccctacagaacccccacagtgtgttggtatcttccctccactttccccgattcatgcctctcttctttacccgcttccaccctgctctgggcccccttgccctctctcttcttgctgggtttgctgctgggagtctgcaggcgataggaaggacagaggagaaaggggtcagggtactaacttcccaagcccccccttacagagtcatgggcmagytgcattcctctaccaaaggtttcagcttctgccagggggtgtgcccaagagctctttctctctgggtcaccacgcctctcttcctccctcccagcccaaggctagccatggygcccaccgyttcttgtccagggtactgccatcatgtttctctgtatcctgtctatgctttacaactggtccttmatcaaattctgcttamatggcccaatttgatgkcttattggtactytcacctgatgactggacctaantcggaccagaaaagaaagtccgttgttactctggtctaat

SEQ ID NO: 5065 - DNA, 646 bp, Homo sapiens
ttaaaatcatttttagtagatttatatttcatgctcattgcaaaatcctcagtatacctccatgtacaatatatatggcagaaagcaaaagttcccctaaaatcctatttcctaggataaaattccctattaagtatcaagtttgtcatttgagaacctttctaggtatatgtaaaatatgtctatgaaactttttacatacataggattgtactgtagtttctgttctataatctgctttcattagagagtggacaactttttgtgccaattcataaggatttacctgatccttttatccagccacataatattccataatacaaatgtatcatgctatcctatggaaagccatctgcttttttcctataacaacactgcagtgagtattcttgtacataggtttttcaatattkgcatcagtaaatttctaaaggtaatttcctgggataggaataggaatggaataggaatctccaagtcatagttgttacaaatgttttatggttatgaatttagacatttgagactttattttggaaaaaaaacatgaagaataacaaatttatatttccatcttcttttctcctgagtttctaactcatacctgtctgttcacattacgtcttaacttggttgcctacta

SEQ ID NO: 5066 - DNA, 403 bp, Homo sapiens
  misc_feature (15)..(15): n equals a,t,g, or c
aattcggcacgagcntggaatgggaggctacggaagagatggaatggataatcagggaggctatggwtcakttggaagawtgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatggggaaaaaaaaaaaaaaaagaattcaaaaagcttc

SEQ ID NO: 5067 - DNA, 1400 bp, Homo sapiens
ggcacagtttattaatacctattatgggaaagtcactttggttggcattgaaaattacatcatctttaaagcagtatttgtccccagatggactcatcactagcaaagactaggttcattggaaggcatagggtgagagaatgggaagatgragtggaggcgggttgttaaagtgctgtcagtgagtgattttgtctacttgaataatggtccatgtttgggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagttttttgtttttttgtttgtttgtttgttttggctccttagtaatactcctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgraagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttgtttttactgttagagtctcaagtttagaaatgctaacacttaaatcagtttttttctcactatacttgaagattgttaatattttgatatcttcctagcttgatggaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaatwacaaaaaaaaaaaaaaaaaaaaaaactcga

SEQ ID NO: 5068 - DNA, 1198 bp, Homo sapiens
  misc_feature (7)..(7): n equals a,t,g, or c
ttatagnaaggtacgcctgcaggtaccggtccggaattcccgggtcgacccacgcgtccgggctgaagtcctgcgagcgacgcgcggcggggcggcgagaggaaacgcggcgccgggccgggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttaaaaaaaaaaaaaaaaaaaaaaaaaaaaaaaaaaaaaaaaaaaaaaagggcggccgc

SEQ ID NO: 5069 - DNA, 1161 bp, Homo sapiens; identical to SEQ ID NO: 4697

SEQ ID NO: 5070 - DNA, 1763 bp, Homo sapiens
ggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggaggggatggaggccagctagtcagcatcgagttctgaagatgaacagaaactgatagaaaakttcattgaaaacctcttgccatctgatggtgayttctggawtgggctcaggaggcgtgaggagaaacaaagcaatagcacagctgccaggacctttatgcttggactgatggcagcatatcacaatttaggaactggtatgtggatgagccgtcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgkggtcaccacagttgtatgttgggtttggatctgtagaaaaagaaaacgggagcagccagaccctagcacaaagaagcaacacaccatctggccctctcctcaccagggaaacagcccggacctagaggtctacaatgtcatwagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggttggcctgtgcatcggcaattctcatatctgtttttttcaaagaataaaatcaaataaagagcaggaaaaaaaaaaaaaaaaaaaaaaactcgag

SEQ ID NO: 5071 - DNA, 612 bp, Homo sapiens
  misc_feature (514)..(514): n equals a,t,g, or c
  misc_feature (525)..(525): n equals a,t,g, or c
  misc_feature (563)..(563): n equals a,t,g, or c
  misc_feature (603)..(603): n equals a,t,g, or c
tcgacccacgcgtccggaatgtgtgtgtgcggtgttatgccggacaagagggaggcgaccgcggcggcggtggctctgtttattgtccctctcggtgtgtggatgcgaggaagtcgggggtatagcgctgctcacgaaggcagcctttgaggcagcggcccggcgttagctgcgactccggcaaccccagcggccggccttcgcggagtgtgaggaaggacaaggcgcctttgcgtccccgccacgtctggacgccccgagctttccggctgcgctcgccgcgcgcacctccgggccccggcccggcttgccgtgccgccggcgggcgggcgagaaggaagcaccgcgcctcaccgctgccggcctcctgcttccttctccacctcttcctcagcgacgggcctaggcccgggcgactcggccgccgcgcctcgagtttgagggcgccgagcggcgcggcctcctcgcgggctcggccgtccgtccgtcccgggtctcagcgatggggcgcggngggcgacgccnctaggagcacggcgagcggagcggtcggkgcggagcanaggggccccggcggccggcaggaaggcgggaacgcggccnctctgctca

SEQ ID NO: 5072 - DNA, 572 bp, Homo sapiens
  misc_feature (504)..(504): n equals a,t,g, or c
  misc_feature (526)..(526): n equals a,t,g, or c
  misc_feature (541)..(541): n equals a,t,g, or c
  misc_feature (554)..(554): n equals a,t,g, or c
  misc_feature (558)..(558): n equals a,t,g, or c
gggtcgacccacgcgtccgctcgcgagtggcgggcatgagagtaaactgcggaaggtcgccagcgggttctagtcattgttggagttgttctcttgtgccgcaggcttcgacgagattggcgcccggtcgcttacttggcgggtgcaatggcgcttttccgatgcgtgtggagcgtgctgagtgccctgggaaagtccggatcggacctctgcgcgggctgtggaagtcgactgcgctctcctttcagttttgcgtatgtaccgagatgtttttcatccaccgcgaatagttacccaaagaagcctctgacttcatatgttcggttttctaaagaacagctacccatatttaaagctcagaacccagatgcaaaaaattcagaactaattagaaaaatcgcccaaytatggagggaacttcctgattcagagaaaaaaatatatgaagatgcttacagggcagacttggcagggcatacaaagaaagagataaacagaattcangaaccaggttaacctccaagtnagattggtttctttngaaaaaagaaatncagncaaaaacggtttaa

SEQ ID NO: 5073 - DNA, 1244 bp, Homo sapiens
  misc_feature (871)..(871): n equals a,t,g, or c
  misc_feature (1218)..(1218): n equals a,t,g, or c
  misc_feature (1227)..(1227): n equals a,t,g, or c
  misc_feature (1244)..(1244): n equals a,t,g, or c
gggtcgacccacgctccggtgcagtcttctgcttcggctcccactggcgctcctcccagctgctgttgtagcgccccgtcttcagtcctgtggctctgccctgcgttcttctgctccctgatcctgcatgcaaaatgggacctttcgccccaacgctgctgatgctgctgcccccactgctgatgctggtcctgtacggctgctggcaagcaagaggctgggccggacatcagtatgagcatcaccgcggacctggggaacagartgcagcatatttccaggctatgagattcaatgccaacatgtctttccacgcccaaatggttatcaatgaaggtgaggctttccgtgaagggcaaaggaccatcccggctgtggagaggccggggaatgctctgaggcagagatcatgaaggtgacatttccccgtatggataccaacaccgtgggcacctctcgcctttcttgagatcgacggcttaaattggttttgaataccacggtgatactataaattaccctttgtcctgctcagttattgatttagcccttttctgkgctctcgtcacctcagagaataggactaccttgtcccagcactgtggaagccgtgaagcccactccttctcagctctgggttttgacttctccacagcttcacctgccagaccaaggctttctgcttcccatcgcccttggtgctattttcctccaattcctgtgtcctcctttctctttttgtgcctccatcactcccttaacccttctccatcttggaattgctttccttccctttggagtcccagatccctaccccttctccttagttcaggataacataaatacatccttttgccttgtcggggaccgnctctggcctggaaaatcccgcattacaagatggcgcttggctcactgccagcaaaatacgctgcaagtaaacaacgaatgktctggtgaagcctgcctaaaggaggacatagtcattggctgkttcaaawttaatcagcatagtaacaggactctcatggctctycccatkgtttggccccttawtggkcaccctgctcgctgawtggtcatgtaaacgtatataagtgkgkagacttgcggaaataaagagagagaagatacatctgaaaaaaaaaaaaaaaaaaaaaaaaaaaaaaaaaaaaaaaaaaaaaaaaaaaaaaaaaaaaaaaaaaaaaaaaaaaaaanggggggccnttttaaaggatccctcn

SEQ ID NO: 5074 - DNA, 1551 bp, Homo sapiens
  misc_feature (1513)..(1513): n equals a,t,g, or c
ggtcgacccacgcgtccggaaggagggagctgcagggactggagtatctcaggccctctcagtgggtggggcccggagcaggggtacctggggaaacaggcctccctctggaattcggagcagagctgctgtctaagtcacggacctctggaatctataagacagaggactgcaaaggggtgcaacactccaaaaggacagcttaggacacgcaccatgtggtgggccctgctggcctgccgtttctgctgcccacggcgctgcgcctctgcttggcagggcctcccccggagaggggccctcttttctggctgactcggcaggactctcgggaaagcggggccgccaacgccacggtctcgccctgcgaggggctgccctctgcgggagcgtcgaccttgaccctggcgaaccgcagcctggagcgcctgcccaactgcctgccgcccgcgctgcgtagcctagacgccagccacaacctgctgcgcgccctgagcgctccagagctcggcgccctgccgcggctgcaggcgctgacgctgcgccacaaccgcatcgccgagctgcgctggggccccggagggccggcggcgctgcacacgctggacctcagctacaaccagctggccacgctgccgccatgcgccgggcccgcgctgcccggcctccgctcgctggcgctcgccgggaacccgctgcaggcgctgcagyccgkggccttcgcctgcctcccggcgctgcgcctcctcaacctctccggcaccgcgctgggccgcgacctgggagcgggcatcgccgacggggccttcgcgggagcgggcggcgcgctcgaggtcctggacctcagcggcacgttcctggagcgcgttcggtcagggtggatcagagacctgccgaaactcacctctctccacctgaggaagatgcccaggctgcggatcctggaggcggccgttttcaagatgacccccaacctgcagcagctggattgtcaggwctcgtccgccctgacttctgtccacacacagctcttccaagacactcctcgcctacaggtccttctattccagaactgcaacttgagttctttccytccgtggagcctgcattcctcccaagtcctgtccatcagcctctttggcaaccccctcatttgcagctgtgaattgtcctggctcctcagggatgcaaagaggactgtcctaagcagggcagcagacactgtgtgtgtaccggcttcaggatcccgagacaccttctcagcccctctttcgctgtcccagctgcccactgtgtgtcatctggaccaaagcaccaccctccattccagctcgccccaggctgttcccttcacccaccaaccatcaacacagggtctcaccaccccatggagcacagccccttccactcgacctgtggaagctgaacagagtgtcaccaagcccctctccttccccacggattccgccacacaaaccgcatggtcccacagtggcatcaaagtggggaccgnccgctccacagccatccccacagcagattctagcacct

SEQ ID NO: 5075 - DNA, 575 bp, Homo sapiens
  misc_feature (273)..(273): n equals a,t,g, or c
  misc_feature (381)..(381): n equals a,t,g, or c
  misc_feature (551)..(551): n equals a,t,g, or c
  misc_feature (558)..(558): n equals a,t,g, or c
ggaaggaggagctgcagggactggagtatctcaggccctctcagtgggtggggcccggagcaggggtacctgggaaacaggcctccctctggaattcggagcagagctgctgtctaartcacggacctctggaatctataagacagaggactgcaaaggggtgcaacactccaaaaggacagcttaggacacgcaccatgtggtgggccctgctggccctgccgtttctgctgcccacggcgctgcgcctctgcttggcaggccttccccacngattccgccacacaaaccgcatggtcccacagtggcatcaaagtggggaccgcccgctccacagccatccccacagcagattctagcacctccagcgctccgcagggnctgcaaacacagctggggcagagcaccaagagcacgctcccatgctggtccatgcgcctcacgtgtcagctgcttccaccccctcggccagcaaacaccctgggctcttccctaccccgtggagccaggtgcggacgccccagcccgactacagggcacaggccaccctncaggcgnctcacccaagtccttct

SEQ ID NO: 5076 - DNA, 854 bp, Homo sapiens
  misc_feature (281)..(281): n equals a,t,g, or c
  misc_feature (846)..(846): n equals a,t,g, or c
gggtcgacccacgcgtccgctgtcagctcagaatgcctctgtgaatttctgggaagccagcactctcgcagcacaaagggaacttgccatgcagtttctctgtccggggaaccactgctttccctgccaccttctctgtgcccagaaacgttacaattcacaccagmccactcccgttgtcacagcgcaccttgtgtgttgtgtttttcagcagtcagtgctccttggtgtccagttgaatagattgggtgtgtaagtaggaagagataaamcagttcacncaagtcagtctcttttgccattctggaagtgacatcctcaagtcatttcagggacgttccctctggtcaagcttctggctaaagcaggtggtattcaaggaatcaactcctgtggattcttaatctgagaactggggtaagggagaactactggttatgtttcctgaggctgcctggggtttattgcgtctcttggcaaaaaaaatgtgcttttagctttgtagttaaaactgcagtcttctgggaacctctgtgaaacacaaggacaagctgtcctttttaaagtcattgtctactggacttctccatagtgtaagtggtcaaagaaactacgaactccttttcttaaaaaagcgcaataggatcacttccgggatttggtcttttaagagaagagatgarcaaaaaagaacgtcaaggctctagctagaagccaaagccatttgctctccattgcatcaaacagtgccttcatgatttgtatctgagtgtgggcaaggcctttcaacatcccttttcacttgtataccaatgtcaaaaaagcattttttataaaccttacggntgtgtgtc

SEQ ID NO: 5077 - DNA, 917 bp, Homo sapiens
ccacgcgtccgggctcaccccaggccgagaccaggtggtccgaccccatcgctcttcaccaagggaagtcgccagcctccatcgacacgtggccagggcgacgcagtggtggtatgatcgtcatcacctctatcctctcctccctggccagcctcctgctcctggccttcctggcagcgtccaccgcacgcttgagccctcagtcacttccagagacctgataccggggttagtcagggcaaccacctggaggaagtgggccaggagctgcttctagaaggaaggaaagggagagactgcaggaggaccggggacccagtgctgcctcctctccccatccagctccagcctgtggtggccggaggaggccccggagcagctgagaattggctccttcatggggaagcgctacatgacccaccacatcccacccagcgaagccgccaccctgcccgtgggctgtgagcctggcctggaccccctccccagcctcagcccctagcctggcccttgtggctggggcgtgtgtggctgtggccagtgtgggggcaaggacgtggtagttattcccagcccctgcaccctcctcctcacccctgccaaagtcccactgatgtaggacagatgtcagggttctagacgtctttggtgcaaaaagggggttttattcaagcacagggacaggacccatgggcagggagagcggcaccggggtggtgaggagtggcccgttatatatactttcgagttgggagggcttagagagagcgtaagtctctaaggaattttggaagcaaggtctccagggtcctgagggggctagctgttgttaggaaaaggtcatttattactgtttagtaaaaactttcaccagaaaaaaaaaaaaaaaaaaaaaaaaaaaaaaaaaaaaaaaaaaa

SEQ ID NO: 5078 - DNA, 1384 bp, Homo sapiens
tcgacccacgcgtccggccggactaaccagctcctccaggcgctgggggcgggtgtggcaggaggaagcccgatcagccccaggctgtggatgtgggagaagggcgagctcagggggccatcatggggttcccccagaggcaacctggcctatcagggctgctcctcctcgtgtgggcactggcctggcccctgccttgtatgagcttggagctgatcccctacacaccacagataacagcttgggacctagaagggaaggtcacagccaccacgttctccctggagcagcctcgctgtgtcctggacgggcttgmcggcgttgccagcaccatctggctggtggtggccttcagcaacgcctccagagacttccagaacccacagacgcgagctgagatcccagccttcccacggctgctgacggaggggcactatatgacactgcccctgtccctggaccagctgccctgtcaggaccccgcaggcggcggcagggacgtccccttgctgcgggtgggcaatgaccccggctgccttgctgacctcctccagccgccctactgcaacagccccctccccagccccggaccttacagggtgaagttcctcctgatggacgccaggggctcaccccaggccgagaccaggtggtccgaccccatcgctcttcaccaagggaagtcgccagcctccatcgacacgtggccagggcgamgcagtggtggtatgatcgtcatcacctctatcctctcctccctggccagcctcctgctcctggccttcctggcagcgtccaccscacgcttctccagcctgtggtggccggaggargccccggagcagctgagaattggctccttcatggggaagcgctacatgacccaccacatcccacccagcgaagccgccaccctgcccgtgggctgtgagcctggcytggaccccytccccagcctcagcccctagcctggcccttgtggctggggcgtgtgtggctgtggccagtgtgggggcaaggacgtggtagttattcccagcccctgcaccctcctcctcacccctgccamagtcccactgatgtaggacagatgtcagggttctagacgtctttggtgcaaaaagggggttttattcaagcacagggacaggacccatgggcagggagagcggcaccggggtggtgaggagtggcccgttatatatactttcgagttgggagggcttagagagagcgtaagtctctaaggaattttggaagcaaggtctccagggtcctgagggggctagctgttgttaggaaaaggtcatttattactgtttagtaaaaactttcacgagaaaaaaaaaaaaaaaaaaaaaaaaaaaaaaaaaaaagggcggcc

SEQ ID NO: 5079 - DNA, 2218 bp, Homo sapiens
aggtattaggcccttttgtgggagccccatgttttgtttttctgagttggtggggagggasggagggggagggctgaattgttttgcagaggaagatggcatctgtgctttaaatttctcattactgggttagaaaacaaagagggaktgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatagtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgyaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataaaaaaaaaaaaaaaaaaaaaaaaaaaaaaaaaaaaaaaaaaaaaaaaaaaaaaaaaaaaa

SEQ ID NO: 5080 - DNA, 695 bp, Homo sapiens
  misc_feature (686)..(686): n equals a,t,g, or c
tcgacccacgcgtccggaagaggaggatgaggatgaagatgaggaagaggaagtggcagcttggaggctgccccccagatggggtcagctgggagcttcccagcggcctcgtcctccccgccctactcatcgaaaaacctgctcccagcgccgccgccgagccatgagagccttccggatgctgctgtactcgaaaagcacctcgctaacattccactggaagttttggcggcgccaccggggccggcggcggagctcgcacaccccaagaaccatctttcaccccaggaagggggtgcgacaccgcaggtgccatccccctgctgtcgttttgactccccacgggggccacctccaccccggctgggtctgctaggtgctctcatggctgaggatgggatgagagggtctccaccgatgtcctctgggcccccagtggaggaagatggattacggtggactccaaagtctcctctggaccctgactctggcctcctctcctgtactcttcccaatggctttgggggaccccccgggccagaaggggagcggggtctggcaccccctgatgccagcatcctcatcagcaatgwgtgcagcatcggggaccatgtggcccaggagctatttcagggctcagatctgggcaccscmgragaggagagsggggggagaaagccggccancacagcccc

SEQ ID NO: 5081 - DNA, 1507 bp, Homo sapiens
  misc_feature (1430)..(1430): n equals a,t,g, or c
ttttttttttttttttttttttttttttttttttttttttttttacgtatcaacaaaggatcctttattgaccagagcaggaccgtggcatttttatatatatatatatatatatatatatatatatataaaagtttgaagatctggcaggcagtgatcctattgtccgcccaccacccccagcactgatttcctgctccctgcacggggaagggggaggatgactgctccacccaggccacagggccacactcccctgcaaacagaggaagaaaggggcttttctgtagccaccccctgcacatcagaaatcaacaagtattctctcaaagaaaaaaaaatacagaaattgaaacatttaaatatgaaaaaccaaagggaagtgagtgggaagaggcaagagaggaaaggaactggagtttcttgggaagggactcccatgtctcccttcccatttatgggcttggggtctggggtacgaggctcacacagtgagtttgcagtgacacagctccttgtagatctgccgacgaagtttgggcatgtcctgctgggtgaagctgaatggctgagacagggccagatgcttgcagtactgcaacacaaaagcaccacagtcactgtcattattctgcctggccacattcattttgaagtaacctttccagccctggtggaaatccagtcggtctttctttaccgcctctgcctgtagatacttggcaatatgcttagggcagcggcggtttagggtacgctgcgagtcaaaataggtgatggtgcgtcgcctcacatcaacagagatgagggaccaatgcacctccaggtggatggggattagcagtagctccttattgaagatgtccacgtttttggtccaccttttcaccccatcataacccttggtacggagtttatcatagaagaaactattgaagaaatgcaccttttcagggactgtgtccatgaccaggtctccatacatgttcatcacctggtcattgagccagttctgtccatacaaggtccccaagtcatccatggtcagcacgtgccgcttataagccactcggaagcccctcaccatggcattgcctggcatccgctggtamgactggatcagctgcarcaccaggcccttcctggaaggkgtrgaraactcctgctggaaaatgtcctcyaryttctctactacctcrtcagtgctgaggggtatgaggctgccatacgtttgaaggaattcgtccaagatgctctgtacgcaggtcacatgctcctctcgcagggggctgtgctggccggctttctccccaggcctctctgcctcttctgccatgcccaaatctgagccctgaaaaagctcctgggccacatggtccccgatgctgcacacattgctgatgaggatgctggcatcagggggtgccaantgcgctccccttctggcccaaagtctcctctggaccctgactcgggcctcctttcatgtactctgcccaacggtttc

SEQ ID NO: 5082 - DNA, 529 bp, Homo sapiens
  misc_feature (4)..(4): n equals a,t,g, or c
agcnattcacttcacccagcaggacatgccccaaattcgccggcagatctacaaggagctgtgtcatgcaaactcactgtgtgagcgtcgtatcccaggcctcaagcccatggtcaagggcatggggacgtgggggacccttccttcccgagaaactccagttcctctcttgcctctccccctcccagttccctatggtttttcatatttaaatgttttaattgatttctgtatttttttttctttgagagaatacttgttgatttttgatgttcagggggtggccatggaacagcctcttctccctctgctagggaggagtttggccttgtggcctgggtggggcggtcatcccccttcccgtgtgcaggggcgggggcaggaacatctgtgctggggtggtgggcgggcaaagggagtgtgcctgccagatattcaaactttgttttatacgtatatataaacgccacggtcctgctctgctcaataaaggatcctttggaaaaaaaaaaaaaaaaaaagggcggcc

SEQ ID NO: 5083 - DNA, 2736 bp, Homo sapiens
atgccctgccgcagcaggccgcggtggctggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgrttttgcctcccaacaccatttctttttaaataaagcaggatacctctatatgtcagccttgccttgttcagatgccaggagccggcagacctgtcacccgcagtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagrtttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaagtcgacgcggccgcgaatccggaccggtacctgcaggcgtaccttct

SEQ ID NO: 5084 - DNA, 3711 bp, Homo sapiens
  misc_feature (1)..(1): n equals a,t,g, or c
  misc_feature (62)..(62): n equals a,t,g, or c
  misc_feature (3588)..(3588): n equals a,t,g, or c
  misc_feature (3607)..(3607): n equals a,t,g, or c
  misc_feature (3673)..(3674): n equals a,t,g, or c
  misc_feature (3706)..(3706): n equals a,t,g, or c
ncgatccagcctccggactctagcctaggccgcgggacggataacaatttcacacaggaaancagctatgaccactaggcttttgcaaaaagctatttasstgacactatagaaggtacgcctgcaggtaccggtccggaattcccgggtcgacccacgcgtccggacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacggatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgmtgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcayggatgtcagcaygagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcrctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaayggtccaacagccaacagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtaytggactttaccttgatatatgtatatggatgtatgcataaaatcataggacatatgtacttgtggaacaagttggattttttatacaatattaaaattcaccacttcagaaaaaaaaaaaaaaaaaactcgagggggggcccngtacccaatcgcctatagngagcgattacattcctggccgcgtttaaactckgctgggaaacctgggtwccaattatcgcttgannatcccttgcagtgggtatacaaagcccacgtncttca

SEQ ID NO: 5085 - DNA, 790 bp, Homo sapiens
tgtgtgtgtgtgtgtgtgtgtgtgttcatataacaggaggacaggaaaggtaaggacccagaacaatgaagacttattgaaatgtggtatgtgtgtgcgtgtgtgtgtgtgtgtgtgtrtgtgtgttcatataacaggaggacaggaaaggtaaggacccagaacaatgaagacttattgaaatgtggggggggtgtgtgtgtgtgtgtgttcatagaacaggaggacaggaaaggtaatgaccatccatggaagatgaaggggtagtacttagcaccagaatcttttccagtttttacccatctttcattactccttgtctccaaatcaycccttccttaataacttaaaataacttaaaatattttctgaggacttgatgacaccagtcagaagtccaagagtggtctggtataagggagtgttcatcaaggggcagctggaaaaagtggaattggcacaggcaacatctttcttttcagatgtttgaggtcacccagaggagataacagtctgtcaacatagagccctcaaagttaaaaagcagtagccaggcaagacttgtgtcttttcagggctcttccaggctctaagagtgtgaaattcagacagktttttaaaaatcaaaataaaaggagagtagttcttacaggcagaaactcttagagctcacaaattggaaacaactgcaaacttcagagtaaattcatagcttccaaatacaaatgttcacattgtccctccgctatttttacacaaatgcattcaggtgaagacagcaacacacatt

SEQ ID NO: 5086 - DNA, 1203 bp, Homo sapiens
  misc_feature (9)..(10): n equals a,t,g, or c
  misc_feature (13)..(13): n equals a,t,g, or c
  misc_feature (106)..(106): n equals a,t,g, or c
  misc_feature (1160)..(1160): n equals a,t,g, or c
  misc_feature (1188)..(1188): n equals a,t,g, or c
  misc_feature (1201)..(1203): n equals a,t,g, or c
cgggttccnnaanctgccagttgggaaccccctggtagatcctgctatatccagagatttagggcaccgtctctgaaaaagtgccccgggggctttcagccagcanccagccctcatcagcgatgatgccaagtgtcctattgcgtcaaatccgggctcttcmcagragggtccctgccccctgccaggctcccacctttcaccggccacccctcatgagtcaggctgccaccaatactgtcatagtgaccaattctgagaatgcgagatcctggattaaagactcccagacccaccagtggaggctgggagaaccgatagagctgcggagggccatgaatgtcatccatggggatggtggtggtctgtcaggaggggctgcagctggggtcacagtgggggtcaccaccattctggctgttgttatcaccttggccatctacggcacccggaagttcaagaagaaagcatatcaggcaattgaggaaaggcagagtttggttccaggcactgcagcaactggagacaccacttaccaagagcaggggcagagtccagcttaaatctctccccgaaaatggtttctctcatctccagtgtggtcattgctgaccactctgttttcctaagcattgaaatggcaagtgcaaccaaaagtaggtatattcgtgacttcttgtttaggtctctgggccaggaaattcatactgttacatggataaggttgggattggggagagggaacagttgggactagaagcaaaagtgattctgggactaaaataggaagcagatgtcctttcccaatgtgtgttgctgtcttcacctgaatgcatttgtgtaaaaatagcggagggacaatgtgaacatttgtatttggaagctatgaatttactctgaagtttgcagttgtttccaatttgtgagctctaagagtttctgcctgtaagaactactctccttttattttgatttttaaaaamctgtctgaatttcacactcttagagcctggaagagccctgaaaagacacaagtcttgcctggctactgcttttwaactttgagggctctatgttgacagactgttatctcctctgggtgacctcaaacatctraaaaraaagatgttgcctgtgccaattccactttttccagctgnscctggtcttaacccagaggagcataanttcccatccccgnnn

SEQ ID NO: 5087 - DNA, 804 bp, Homo sapiens
  misc_feature (3)..(4): n equals a,t,g, or c
canntacggacttgctctggctgtcttggaggaaggagcccttgaggtggtcctcctgaataagagcagccccagcgtcgacactggtggtgacgtgggtgccatagttgagcaccaggagttctgccaggtaggtggccatcctcgtctggttgttctctagacggtcagagatgtcaaggagttccttcctaaaacctgagcttagctctaaagttgggttgattttgactgtgtagmcgaggtttcttacctgaactcgggtagttatagcttggtccttcacttggagggtcttcatcctctggaactcagtggaaaacttgccattgactttggaaaaaagagagagttctgtgttgatggagtaggaggtgctactctggtaatttgcccaggattccaggatttctgagttcatctccaggttgctctgtttctggggaatggtgaagatttcatcagggatgatatactgtccatcctctgttgtcctgcagttggagtaagtcaattccataactcgtcccatgtccacattccgcagattgtcccagccccctccaggtaggacttccaggacaggtagtttcaaggcattcttgcatttttgaactccaacttcgtccatctctcccgaaggcttgcctgatttagcccatgctgccgctgcccagaagaggatggtggccctgaagttgttcatggctcagacagccccagccactcaccagccctacacagcggccagcgtcgacgcggccgcgaattcccgggtcgacgagctcactagtcggcggccgc

SEQ ID NO: 5088 - DNA, 617 bp, Homo sapiens
  misc_feature (600)..(600): n equals a,t,g, or c
gtaccggtccggattcgcggccgcgtcgacgatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcaccacatcagcagtcaaaagcacaagctgaaatgcagtccagagcctttggcaagktcagcctyctcccaccccggaatgagtgacaatgcacctgcttccttggagagcggcagcagctycacccctactaawtgcagtacctyctcgggcatyccgcarcccggtgcaagcaccaagccttggcgcaasaaatcctyarcgkggaacacaagtggccacggtatccakctyttcgggyaagcttctggggctkaaggccccaaggcccaaaccttgaaagccattgaaanccgggccccaacaatta

SEQ ID NO: 5089 - DNA, 558 bp, Homo sapiens
  misc_feature (390)..(391): n equals a,t,g, or c
  misc_feature (434)..(434): n equals a,t,g, or c
  misc_feature (485)..(485): n equals a,t,g, or c
  misc_feature (541)..(541): n equals a,t,g, or c
gaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctyctctcgaaaaaacctggatgtgcagactgatgctgagaagcactcacaggtggagaggaattcctgtggtctggtgatgatgtcaagaaatcagacggaggctcagacagcggcataaaaatggagccaggttycaagtggaggcggaatccttctgatgtgtctgacgagtccgacaaaagcacgtcgggcaagaagaatcctggcatctccagacaggctcatggcggnnaggcatgacagctcaagtgggcatcaccatgccaaggacgaangcttcagcccggcaggcgcactgaagaccccaggaactggaaaaacagacnacgcaaaggtgtctgagaaaggaaagggttttttctaaaggcttccaagtgaaagnggttcccatcaaatgca

SEQ ID NO: 5090 - DNA, 1454 bp, Homo sapiens
  misc_feature (1)..(1): n equals a,t,g, or c
  misc_feature (10)..(10): n equals a,t,g, or c
  misc_feature (15)..(15): n equals a,t,g, or c
  misc_feature (38)..(38): n equals a,t,g, or c
  misc_feature (53)..(53): n equals a,t,g, or c
  misc_feature (1427)..(1427): n equals a,t,g, or c
  misc_feature (1429)..(1429): n equals a,t,g, or c
  misc_feature (1445)..(1445): n equals a,t,g, or c
nacatttggnattcntaagctaatctttttatttttgnaagggtgtctttctnagaaaggcagccagaggcacagcaccaacctttctgacagtgtggtcttcacactgttagttctgacaaagggagtcaaggagtcgtccttggaggaggcgatgaggccagtggaagaattgtggctggggacccctccactgctgagggagatgtcgatggactcacagctggtgtggaggctgctgacagactgaaagcccaggccatccttgctaactgcggaggagctgctggcgttggtgccccaggtgaggctgttggaaggggccgagtgggctgagctggggctggaggctagcggagactggttgaggtccacattcttgctgtagagaggactgctgctcccactgctcaggacgccactgcctgacggggagtctaggttaccttgctgagtcatggtggcatgaggattggagatgaccaccgaatttttcatgttttcagctgtggcgatgggcacttgcttggtaggcttcccaccaaagagtctgcggagtgtgggagaggccacatctgggtacttggctccaggctggagactggtctgagccggactggacacaggctgggctgccggattcactttcaccgagttacaggaagccacactctcgtkgtctgatgagatgcctttctccttgtctgtttggttgaccagacctggtagagagctgcctagggctgttttggaaggctccctcagtttgggcactggcaggcctgcggacttgctgctaatgttggaatctatgctgctggtgctagacctgttcccagccccgttccggctgttggacttactgggcctcggcaaactccggtactgaaggtttgtccgggagcttagggctagatacccgtcatcctgattctgagccccatccatacttgacttccgaccagcagaccgactgacgagtgcagatgactttgggattttgcccagtgtggctgacctgctggtgacagtcaccccgctggctgtgatcatggccaggccggcggcggaaccactctgcttcttgaacccaaagctgttggcattggcagtaggtgtcctagagctgctggggaggggctttttggattcgtcaccactgctccggcctgcatctgatggggagcgcttcacctgggaggctttaggagaaagccttcctttctcagacacctttgcgtcgtctgtttttccagttcctggggtcttcagtgcgcctgccggggctgaagccttcgtccttggcatggtgatgcccacctgagctgtcatgcctcgccgccatgagcctgtaaggaaaatgacaggattcttcttgcccgacgtgcttttgtcggactcgtcaggcrggyagytgaaactaaacntnggaagtgtaccaccgnctcaccaac

SEQ ID NO: 5091 - DNA, 4631 bp, Homo sapiens
ccgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaatgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaagcggtatacaccgagggcccacctggacgaaggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaagctgacgtcctcttcaccaggagcagcagcctgagccactacgaggtcaagctcaacagctcgctggagagatacgatggtatcgggcctcccttcagctgcatcttcaggatccagaacttgggcttgttccccatccacgggattatgatgaagatcaccattcccatcgccaccaggagcggcaaccgcctactgaagctgagggacttcctcacggacgagggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccgtaaaagcactcaagtacaaatccatgaaaatcatggtcaacgcagcgttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccagacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccacgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacgtcgacgcggccgcgaattcccgggtcgacgagct

SEQ ID NO: 5092 - DNA, 2211 bp, Homo sapiens
  misc_feature (44)..(44): n equals a,t,g, or c
  misc_feature (60)..(60): n equals a,t,g, or c
  misc_feature (78)..(78): n equals a,t,g, or c
  misc_feature (81)..(81): n equals a,t,g, or c
  misc_feature (113)..(113): n equals a,t,g, or c
  misc_feature (126)..(126): n equals a,t,g, or c
  misc_feature (199)..(199): n equals a,t,g, or c
tctaagttccaaaaagcttaagctttcccggtgtcaagtcaagntttgcaacggtggaancctttgaaagccgggtgnccntggcttgtgctttcataatgcccaggaagtgnagaaggaaggctnagaaagcttggtttcccaagcttctgattctccacagggcacttctaataacccttcttctcacccaccccgntacggtytkaaragatytgaaawacmcctttcccagtggcaagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtagrggaccttgtgatctgccgtgcccctcctccctgttcttttctgtcctccccaccccaccctcagaagctgcttgctctgcccccaggacaggagcttgacggatgargtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcarggcccttacgcagtatttctctctctctcctctctggggtgcgtgtgtgcgtgcgcgtgtgcttgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaaaaaaaaaaaaaaaaaaa

SEQ ID NO: 5093 - DNA, 3710 bp, Homo sapiens
gtacccacaattttcaggtgggtgtgtaagagctaatggggccacagatgctatgcataccactgcctagttgttgctagagagccttttcaacctcagagaacatagcattccatgctaaccatcatttaaaattcctgcaataaatgaaaaaaataaacacagagctgagagtataattcaactagcctcgctcccaaatgaagctgattccagatagaaagcagattttcatatttactgtatgtgacagctgcaggaattaaatgaatcatctgtctatctctattgccttgttcctcctgtgctgtgtgcatctatccctggggttgtctgtcttcccattccaggaagacagatcagtgtagtttcaattattaattccatgtttggatcacagtaacaccagttccagttcagtgacctgcagttcctattgatttaagtgatgaattatctacactgcaatgtattattaactttattttgtctcttattccttctgcattcatgcatcaaaataataaagcaccattcacaggctaaaaggacccgtttcccttctcacatttcccataagggcgaagccaacacacaccagggaggtaattacacagagctggggtgggggctggacatttattttacctctgaattatttatctcagctgtgaatttgggggaggggttgggggaggtcctcagtggggaacaaaggggcccaggagggaagttaatgaagacaagtgacgattagaacctgggagattcataagaaatgaaataacctcaacccaaaagtttaacttctgggagtcaatctgcccattctgataatgatggggggatgggtgtaggagtggtaacgacagtggcacagtgtgaagggaaggaggcaagagaagagagcaccatcagtttctcctgccatctcttttggattgctctgcctgccccatcgcaagacctactcagcaaggtcagactccagtgagacatggatttgtggatgtttggcagaaatgtgctggccttatggctaacctaccattgtcttcatcttctttgggtaaaagcacatcctcctattaccttttgaggaacttcctttccctgggtacaatctggtaggactatcaatccagatgccctaccttgctctgaccaaatgcatgacccaagctgggtcagtgaggttctccctccatgacatttgaattacagacaaagggcacaaaagaccgagggtaagtggcatctgttcactagcgctgatgcctgggtctgactgttgagcaattgctgctctcaataccttctgaagatgatctgcaagccttgtttttcaaccttccctttgattctagatgccccaccccatagtctttcaataaatgcttttttttttaagttaactaaatttgagtgtgttttgttgctttcaacttagagaactctggctaagcagccaaaagacatggctgtatctaaagtgtccctgagccctcagagatggaaaaggtgaagagggaggggctagatcttgtctacacctcttctgccaatcaagcaacaattacatcaatagggagatgggcaggaggtgaagtgaaggcattcctctgtcctctcgctcccatttctagttagaactgaatccaacctcccagcctgcaggactcctgttggggcaactcccaaagtcaaggagtctgaagagacacctcatctgacaatcccacacagagggaagacttctggaggggttgcctagggtcaggcaccccaggcatcccgcctatgagccaaacccaagaggaaggaaagacacccaggacctcccagtttgaaagtgaagataaagctgctaagtgcgtagaagtttccatgtgcagacaattggaggattacctaaggtctcatttctagtgctattacactcagaaattgcctcacctatgactgctcccattttgtgactcacagctctctacgctgcactggtatgaaacagatgttgtgaatgttttattgtagtttccaattgccacccttcattcatctgattcagacctaagagccttgggctttcctttcttttctttctcctcctccaccctttgattttaagggcctagaggtgaacatctaacaggcagaacctgattctacctgtcaactcacccccttatagcaatggagaatagcccagcaatgcctgagaaatgagttctttttctttccagaacttcaccacataaggagagaaggatcagaaaaccatgtgattagattatatggaagaaggtcaaagattaaaaatccactgcctctcattattagaggagggatgacagattcagaccagagcacaaaagaaaatacattatttcaaaacaggatatgaaacccagtcccaggtgattagtctctgttaagtaaatttactatctaatcttttaactgtcttccgaaattgctggtccaacattctctccctcctccattggaagcttaaccctgggagggtgctgtcatccaccttaatggaatggggagctcatttcaggggggtgtaggtgggggtggggtggctggggtggaagggtctgtaagtgaaatgcaccctgtaataaaagcaggatgtgtgcactgcagaccagcctgactggaggtaggatggggatggaggttggggcaattgtccttcctttggtttcagagctaggcccataaatgaggagactatccttcaacctcactccaggctcatcctgggaaaactggactctcctctttccgcacagccccaaggggcccacatgtcaaagaatctcatgcttcggggttgctctcaaaccagatcaaccttcaaagctttgattttaaacgaatgctgctctgcaggctaaatatcacaggcctgtgttggggcccgaagaggacaagatgtgcacttggaggccagacaggcttgcaacaccatccaagcaatgagaaaacaagacatagtggaaaagaggatctgtttctcagtatctgtcttggctggggtaccactgtgaacatggcatgcaacaatcagagaggcagaggataccaaacccaaaggaactcttcccctgtttaccaggaggaactcctttttttctgtacttcactattttctcgtctgtttagtctaaaaggctgaactattacacaaagaaagttctctccaagaatgagttttccagagaaagctcttcagacaagggcagtgtttgaaccactctccacagcctggagaatggggtgtgtgtttaacagaagggggctggggccaaacaggactccctgaaggattcccaaggtgctctgtttgtgtgatttatcccttctggaaaatccaaacatacaaatgtgcctgctgcaaaagtcagggcagtctccaggactcaggttcccacacaaagctaaccacatatagcttgcctgccctgaaggttttctctattttaaccttcgtaggttttcaaccaaaacagatgaaagggaggtgcatgtagttttgctggggatcagcagacctcatttctctctctcttcttagctcctaggctcacttcacaaaaaaccctcggagaacaggaactgggcaaaaaggggcttccctcagctcctgggatttcagaaccagacattgtcatcctgttcaccaagcagtcgac

SEQ ID NO: 5094 - DNA, 1158 bp, Homo sapiens
  misc_feature (668)..(668): n equals a,t,g, or c
  misc_feature (1020)..(1020): n equals a,t,g, or c
  misc_feature (1043)..(1043): n equals a,t,g, or c
  misc_feature (1096)..(1096): n equals a,t,g, or c
tacgcctgcaggtaycggyccggaattcgcggccgcgtcgacgtacycacaattttcaggtgggtgtgtaagagctaatggggccacagatgctatgcataccactgcctagttgttgctagagagccttttcaacctcagagaacatagcattccatgctaaccatcatttaaaattcctgcaataaatgaaaaaaataaacacagagctgagagtataattcaactagcctcgctcccaaatgaagctgattccagatagaaagcagattttcatatttactgtatgtgacagctgcaggaattaaatgaatcatctgtctatctctattgccttgttcctcctgtgctgtgtgcatctatccctggggttgtctgtcttcccattccaggaagacagatcagtgtagtttcaattattaattccatgtttggatcacagtaacaccagttccagttcagtgacctgcagttyctattgatttaagtgatgaattatctacactgcaatgtattattaactttattttgtctcttaytccttctgcattcatgcatcaaaataataaagcaccattcacaggctaaaaggacccgtttcccttctcacatttcccataagggcgaagccaacacacaccagggaggtaattacacagagctggggngggggctggacatttattttacctctgaattatttatctcagctgtgaatttgggggaggggttgggggaggtcctcagtggggaacaaaggggcccaggagggaagttaatgaagacaagtgacgattagaacctgggagattcataagaaatgaaataacctcaacccaaaagtttaacttctgggagtcaatctgcccattctgataatgatggggggatgggtgtaggagtggtaacgacagtggcacagtgtgaagggaaggaggcaagagaagagagcaccatcagtttctcctgccatctcttttggattgctctgcctgccccatcgcaagacctactcagcanggtcagactccagtgagacatgnatttgcggatgtttgccagaaatgtgctggccttatggctaacctaccattgncttcatcttctttgggtaaaagcacatcctcctattaccttttgaggaacttcctttccctg

SEQ ID NO: 5095 - DNA, 963 bp, Homo sapiens
ctctttccgcacagccccaaggggcccacatgtcaaagaatctcatgcttcggggttgctctcaaaccagatcaaccttcaaagctttgattttaaacgaatgctgctctgcaggctaaatatcacaggcctgtgttggggcccgaagaggacaagatgtgcacttggaggccagacaggcttgcaacaccatccaagcaatgagaaamcaagacatagtggaaaagaggatctgtttctcagtatctgtcttggctggggtaccactgtgaacatggcatgcaacaatcagagaggcagaggataccaaacccaaaggaactcttcccctgtttaccaggaggaactcctttttttctgtacttcactattttctcgtctgtttagtctaaaaggctgaactattacacaaagaaagttctctccaagaatgagttttccagagaaagctcttcagacaagggcagtgtttgaaccactctccacagcctggagaatggggtgtgkgtttaacagaagggggctggggccaaacaggactccctgaaggattcccaaggtgctctgtttgtgtgatttatcccttctggaaaatccaaacatacaaatgtgcctgctgcaaaagtcagggcagtctccaggactcaggttcccacacaaagctaaccacatatagcttgcctgccctgaaggttttctctattttaaccttcgtaggttttcaaccaaaacagatgaaagggaggtgcatgtagttttgctggggatcagcagacctcatttctctctctcttcttagctcctaggctcacttcacaaaaaaccctcggagaacaggaactgggcaaaaaggggcttccctcagctcctgggatttcagaaccagacattgtcatcctgttcaccaagcagtcgacgcggccgcgaattcccgggtcgacgagctcactagtcggcggccac

SEQ ID NO: 5096 - DNA, 2359 bp, Homo sapiens
cccgtgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagctccaaaaagccttccagaatttcctgaggcaaaaacacccttcccttttgagaaacctaggggcacattggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccaccca

SEQ ID NO: 5097 - DNA, 546 bp, Homo sapiens
tcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcagtcttcctgtcctggggtttcctcatcaacccacaccatgactggacattgccaagtcactgtcccaatgacagattttatacaattcgctatcgag

SEQ ID NO: 5098 - DNA, 557 bp, Homo sapiens
  misc_feature (238)..(238): n equals a,t,g, or c
  misc_feature (485)..(485): n equals a,t,g, or c
ccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacanctgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggwctctacccaccccactaaaaagccagggactcnccgcccacccttgccacccagtcgacgcggccgcgaattcccgggtcgacgagctcactagtcggcggccgc

SEQ ID NO: 5099 - DNA, 1637 bp, Homo sapiens
  misc_feature (726)..(728): n equals a,t,g, or c
  misc_feature (899)..(899): n equals a,t,g, or c
  misc_feature (901)..(901): n equals a,t,g, or c
aaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggargggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacnnntatgggtttatatctgccagagaatttacatataaacacgatgagttatagagatacatctacccttttaatatagcactcatctttcaagagagggcagtcatctttaaagaacattttatttttatacaatgttctttcttgctttgtttaattatttttatatatttntnctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttactaaggagatgtgcaatgctgaagttagaaacaaggttaatagccaggcatggtggctcatgcctgtaatcccagcactttgggaggctgaggcgggcggatcacctgaggttgggagttcgagaccagcctgaccaacacggagaaaccctatctctactaaaaatacaaaagtagccgggcgtggtgatgcgtgcctgtaatcccagctacccaggaaggctgaggcggcagaatcacttgaacccggaggcggaggttgcggtaagccgagatcacctccagcctggacactctgtctcgaaaaaaaaaaaaaaaaaactcga

SEQ ID NO: 5100 - DNA, 1935 bp, Homo sapiens
  misc_feature (1)..(1): n equals a,t,g, or c
  misc_feature (1921)..(1921): n equals a,t,g, or c
  misc_feature (1927)..(1927): n equals a,t,g, or c
ntctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaaacaaaaagtacacagaaatatttattaaaatgtaatacagtttattgaactttctaggtatggagtttgatggacagggctgcctytaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagnttttgntttttttt

SEQ ID NO: 5101 - DNA, 2269 bp, Homo sapiens
ggctgactgtgscgtcccttcccctcacccgctccacgccctcctgggccgagtggagttgggtggtgtcgggagcctctccctgaggggcaccgcgkcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgktattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagarcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccaggttttatttatctgaatgattgttgcatttgaatactgtagccatggtgagtgagcagttgaagacttcctttctgcaccttcatagttaagggttcatcttctcaagaaataaagttgtgctgggttgtttcaattctgtagatcacctagaaactaggtaacaaggcccttggatcacaatgagcacattgcaggtctttggaaatgctgggaaggggttacattcaagtaactgctgacgtccttcctctctgtcagacccatgttggcctgtaattatatttttctgaatctaaaaacaaatagaaatttctgatatcttttcagtctccttcttttctttccattcatcacttaaatctcattattgtataacgtttcaaattatgacctggattgaaggaagtctgttttgtcagggactttgttaggtgaacatcagaatctcaactacaacaaagctg

SEQ ID NO: 5102 - DNA, 2269 bp, Homo sapiens; identical to SEQ ID NO: 5101

SEQ ID NO: 5103 - DNA, 1350 bp, Homo sapiens
  misc_feature (15)..(15): n equals a,t,g, or c
  misc_feature (1343)..(1343): n equals a,t,g, or c
ggcacgagtgcgcangcgtggggctctctccttgtcagtcggcgccgcgtgcgggctggtggctctgtggcagcggcggcggcaggactccggcactatgagcggcttcagcaccgaggagcgcgccgcgccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaaaaaaaaaaaaaaaaacctsggggggggscccggtccccatttggccctttggggggnggtttta

SEQ ID NO: 5104 - DNA, 1274 bp, Homo sapiens
tttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggaacacagcctattggatccctaggctcaatatgtcctaatagttatggaagtgtgaaagatgtgtgcactgcaaaatttggctccaaacatttttttcatcttattcctaatggaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgagaaaaaaaaaaaaaaaaaaaaaaaactcga

SEQ ID NO: 5105 - DNA, 1444 bp, Homo sapiens
  misc_feature (948)..(948): n equals a,t,g, or c
acccacgcgtccgctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcnatggtgcttatttttaaaatgtaattcaagtttacagtattacttaatgcttctttacagatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccacaaaaaaaaaaaaaaaaaaaaaaaaaaaaaaaaaaaaaaaaactcgag

SEQ ID NO: 5106 - DNA, 1662 bp, Homo sapiens
gcggccgccgagccagtgccccgcgggggtaacagatgaagcacatctggacagctgtgcgacctcctcgcgggccgacgtcagccgagcacgtcccccacgtcctctccttctcgccacttattatttattcgttttcccaaagaagcgactagggacccaagtttaaaaattccyccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcagamaaaaaaaaaaaaaaaaaactcgagggggggcccgacccaacttcgccctactacgtg

SEQ ID NO: 5107 - DNA, 200 bp, Homo sapiens
  misc_feature (1)..(1): n equals a,t,g, or c
  misc_feature (98)..(98): n equals a,t,g, or c
nggagaatatattataaaattttcagacagtatatcagaaaaatgtttttatttgtactgtatagaaaatgtaattttgctgttaactckgkactttntaaattgaaaatgttttataaatttgcttttaaattttcttatgaagccatttgcaaattacatacttaatttaataaaatactttagccacaaaaaaaaaa

SEQ ID NO: 5108 - DNA, 1498 bp, Homo sapiens
gttagctactgagtggcacatcttcagtacgcatgattcgtgggggactcaggcagaggtaaaagtgtgaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcagacaaaaaaaaaaaaaaaaaaaaaaaa

SEQ ID NO: 5109 - DNA, 1365 bp, Homo sapiens
ggcacgagggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaatttataaaaaaaaaaaaaaaaaa

SEQ ID NO: 5110 - DNA, 1308 bp, Homo sapiens
ggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaawgtgtattattttttgtcttgttgtwggtctattttctcccaatttttttttgaaattcagaggctcatatctgaaatagaatttttagttcct

SEQ ID NO: 5111 - DNA, 1520 bp, Homo sapiens
gaattcggcagagcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagccaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaaaaa

SEQ ID NO: 5112 - DNA, 1508 bp, Homo sapiens
ggcacgaggacatggcgtagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattccccgagccaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaaaaa

SEQ ID NO: 5113 - DNA, 1910 bp, Homo sapiens; identical to SEQ ID NO: 2750

SEQ ID NO: 5114 - DNA, 623 bp, Homo sapiens
  misc_feature (537)..(537): n equals a,t,g, or c
  misc_feature (565)..(565): n equals a,t,g, or c
  misc_feature (574)..(574): n equals a,t,g, or c
  misc_feature (576)..(576): n equals a,t,g, or c
  misc_feature (611)..(611): n equals a,t,g, or c
ggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaaragtatttgaacttgttgaccagattaatccatctattttctgsattcatattacaaactgcagatgctctgtgtganttgtaatctgaagtgataactggccagngactgtcangntctctgtcgtaacaccagcccagtgaacatgccancctgcttccttc

SEQ ID NO: 5115 - DNA, 866 bp, Homo sapiens
  misc_feature (13)..(13): n equals a,t,g, or c
  misc_feature (15)..(15): n equals a,t,g, or c
  misc_feature (24)..(24): n equals a,t,g, or c
  misc_feature (82)..(82): n equals a,t,g, or c
  misc_feature (111)..(111): n equals a,t,g, or c
  misc_feature (119)..(119): n equals a,t,g, or c
  misc_feature (122)..(122): n equals a,t,g, or c
  misc_feature (139)..(139): n equals a,t,g, or c
  misc_feature (862)..(862): n equals a,t,g, or c
ggaatttttcccngncaaaccccnacctttcaaaaggggtattttggacctttgttgccccagattaaacccatctattttnctgcaattcatattacaaacctttaaccntgcattanccntttattatccagaagtnccctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggattcctgccagctcccaggggctttggttatagaagtgaagtggactaaatacggatccctgctgaatccacaggccaaaatagtcaatgtaactgcaaatctaatttcatcctcctttcctgagaatgctcagatgcatcagttccttaatatacacgtgaaatttgaaaactgtacattcggtgagattaaattttatatacaactagctaaaaagtagtctcgaggggggcccgtcccaatcccaanttcg

SEQ ID NO: 5116 - DNA, 916 bp, Homo sapiens
cctttttacagcagcccggaaattctgagggtacctgattcaagaaaaaaggtccctatcactgttcagtccatcgtcattcaatctctaaataaaacgctcacccgacgggaggacactgatgtgctgcagccgactctcgtcaacgctggacactttagccttkgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataagggtggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaaaa

SEQ ID NO: 5117 - DNA, 608 bp, Homo sapiens
  misc_feature (1)..(1): n equals a,t,g, or c
  misc_feature (4)..(4): n equals a,t,g, or c
  misc_feature (6)..(6): n equals a,t,g, or c
  misc_feature (29)..(29): n equals a,t,g, or c
  misc_feature (57)..(57): n equals a,t,g, or c
nggntnccgaagacaggttacccggcccnatcctccccaggggatttcagctatggncatccttgggaggggaattcccaaggctgcaaattcggcccatgtgtcatgctcccaactgtctctctgtccgtccatctgtccgtccgtccgtccatccatccatccatccatccatcccagtgactattagcacacctatgtgccagatgccttacatatctaacctcatgcaagtcccaccaccaccctgccctttgttgattcaatagatacttgccaaaggcctgctctgtgcaagacggtggggccagtaagtatagcccctgccctcaaggagcttaagccccatttkctgctgaaatggggagcagaggtggacagggcatgctcccatttgctcacaggaagtgatttcccttcctttcccatctgttagtctgttctcatggtgctataaagaattgcctgaggctgggcgtggtggctcacacctgtaatcccagcactttgggaggctgaggtgggaggattgcttgagcccaggagttcacagctagcttgggcaacatagcaagaccccgtctcaaaaaaaaaaaaaaaaaactcga

SEQ ID NO: 5118 - DNA, 530 bp, Homo sapiens
  misc_feature (522)..(522): n equals a,t,g, or c
gctcgtgccgaattcggcacgagctggtgcctctttctcttaagtccaccaatcctactggattagggttctacccttacgacttcatttaaccttagttacttcataaaagccctttctccaaatactgtcacactgtgggttagggtttcaacgtatgaattttgaggggacatgattcaacctgtgacagtgagcattctcagacctacctaactcctgttgtagtccttattctgagtggtcctcagttctctgagtggccctgaccaggtgtcatgcccacagtggarcagtcgsctcaatgattgctctcatgggcacatargcsagtcctctggggggcattgcaaggcctctcactgcttagttccccatgggaaagctgamcttaacactactgctttgtctacttcagctcctgccaccagaagtatactacagcaggtggggtgccaacatgatggctcaaactccgctaaatccatgargtcccttggsctatggaaatttaataatttnccccttat

SEQ ID NO: 5119 - DNA, 989 bp, Homo sapiens
  misc_feature (39)..(39): n equals a,t,g, or c
  misc_feature (74)..(74): n equals a,t,g, or c
  misc_feature (96)..(97): n equals a,t,g, or c
  misc_feature (104)..(104): n equals a,t,g, or c
  misc_feature (813)..(813): n equals a,t,g, or c
  misc_feature (833)..(833): n equals a,t,g, or c
  misc_feature (934)..(934): n equals a,t,g, or c
  misc_feature (959)..(959): n equals a,t,g, or c
  misc_feature (968)..(968): n equals a,t,g, or c
  misc_feature (982)..(982): n equals a,t,g, or c
tttccccttattctcctcttctgtttttataggttcagnttagatcaacaggtccactacctatacagatggtncaaatgggcaatatgatacagnnccccccntttatcatacaaaggcattgtctactctctgtgagagattattctggagtcccttgccgagccaccctttaaactttagaaaaggtacaaaataatttctgagacactcatgtagcatccctatgaggtcaattccaaagataccgatgactcccttttccctctccatgcccaagtctttaaatagatagattggtgtggatagacagattataaatgagaggtaggtggatagacagacaattgaagggtttgctcaattatacatgattcatgatwkatacmyaaattcmyagctataggattgattgatagagggtagatgccagatggatggatgatgagatagataataaatgataatagctagctagctagataactgcatgggttttgcttcttccaattaagccccgaagaagtgagttggtgccccaatgttggtagttcttttgactgagtggtactgagcacatgttgttttgtctgtgtgctgtagagcaggggtcagtaaactatcaggccctggaataaggccaaagaatcatatataatctggggcctgtttttgtatagcctgtgagctaaacatgggttttatatttttgaaggtttgtgaaaaagcaaagtgacaatggcaatggcaaagcttaaaatatttaatagtatttaatagaaaaagttgactaatccctactctgaggccagnttagaggcaatagaaaatgntcctttcaaaatcctggtacacatttccctgattttttcaggtgaggaaaagggaggctgggatggggatttaacatttcttttttgggcccacagaagantaacattaataaatatttattaagnacatgctgnaaaaataaaactgnggttaag

SEQ ID NO: 5120 - DNA, 629 bp, Homo sapiens
  misc_feature (41)..(41): n equals a,t,g, or c
  misc_feature (48)..(48): n equals a,t,g, or c
aggtattggatggaaaattaatggtcaaatacattcctggnaattttnaccactctaattgccaacaaagtacttgggcaagacttggggaactcatcctctcactgaggttctaggatccttatttcaagcccatttcattccataactgatccagaagtcacttttatagacccttatagaatcaccctttattatattcaagcaagtgtgtgccttgtgtagtttagatatgccagtactgttgtctttggaatcaagagatgagttcaaattactagattcttgtgtagtatatctatgactatataaaaataatttcaatactactacagtagtttttagattgtaaaaaaagctgttgttgtttatagccacttgagataactgaggaacattttttcttttggccaaatatgcatttttctgagacctctctggaggggagtggaacgttacaactagaaccaggctctgggaaatacaaccacatctgtgtttcgtaatgattttgaagctagattttagttgtagggattttttgtctattctgccaggggtattaacatactcacttcctgtaaaaagatttaaaaaaaaaaactaagaaaaaaaaaaaaaaaaaactc

SEQ ID NO: 5121 - DNA, 2746 bp, Homo sapiens
aattcggcacgagcgccggctcccggccgggccgcggccgccgaccgttgagccgccggctgagccgcctgctgaagtccctccctcaggaacccctccgccaccctccacctccgaaccgctctcgcggcggcgacccatgtgggggttcaggctcctgcggtcgccgccgttgctgctcctgctgccgcagctcggaatcggaaacgcctcgtcctgctctcaggccagaaccatgaacccgggcggcagcggcggcgcgcgatgctccctctcggccgaggtgcgccgccgtcagtgcctgcagctttccaccgtgcctggagccgatccgcagcgcagcaacgaattgctcctgttggcggcggccggggagggactggagcggcaggacctccccggggacccagcgaaggaggagccgcagccgccgccccagcatcacgtcctctatttccctggggatgtgcagaattaccatgaaattatgactcgtcatcctgagaattatcaatgggaaaactggagtctagaaaatgttgctaccattttagcccaccggttccccaatagttatatttgggtgataaaatgttcccgaatgcatttgcacaaattcagctgctatgacaattttgtgaaaagtaacatgtttggtgccccagaacacaatactgactttggagcttttaagcacctttatatgttattagttaatgcttttaatttaagtcagaatagtttatcaaagaaaaagtttgaatgtttggaataaggactccatagcatctaactgtagatccagtccttctcatactacgaatggttgccagggagaaaaagtgaggacctgtgaaaaatctgatgagtctgccatgagtttttatccaccatcactaaatgatgcatcttttactttgattggattcagtaaaggttgtgttgttttgaatcagttgctttttgaattgaaagaagccaaaaaagacaagaacatagatgcttttatcaaaagcataagaacaatgtattggctggatggtggtcattctggaggaagcaatacttgggttacttatccagaagtcttgaaagaatttgcacaaacaggaattatcgttcacactcatgtaacaccttaccaagtacgtgatccaatgagatcttggattggaaaggagcacaagaaatttgttcagatacttggggatcttggtatgcaggtgactagccaaattcattttacaaaggaagctccttccatagagaatcacttcagggttcatgaagtattttgagattacaggtatattaatgaacttgttcagtggaagaacataagcacttttgagtgttataaattcagataatgggatgtaattcatagctgcattgtcagttttggggtatggggggaagcacacattcctaaaatgtgagtgtaatgtgcaatagtattttttgcttgtgaatgtgagcagttattaatttggattgagttagaattagttaatttgaaatctaacaaggtggtttgtaataatgctgaggagatataagacccttaaaatgaaagttacaacattgttcttataaaaggtaactaaaattgttactgttggaaataactgattttctgagtaatgttttaaactaatttggtgacattttaacagtaattagctattttgagtggaaatattttcatttctcttcaaacaaaagcaaaggtacgatgctgttttctatcattttggaataactgcaccctgccttttgtgtttttgtaaactccttgactcattctttcatgtgtcaccaagtacttttctcatgagagtcaacatatatttgtttccaaatgtccacaagtgtacaatagtgtaaaggtggtttttaaaaacatagccaggtgtggtggcacgtgcctttagttccagctactcaggaggctaaggcaggaggattgcttgagcccaggctgtgtggttcaccataattgtgtttgtgactagctactgcactccaacctgggcaacatagtgggacttcatctctaaaacaaaacaaaacaaaattacacttaagcactattgtttaatttttaattgtcagtttatcattattttgggtaagacattctggggtttcttgaatcttgtccaaaaaccagttgttttggaaaattgctttaaattgagcatatttatgtatattggataaaaatgtactacagagcaaatttcaaatttttcattatatcagtctttttgaaaggatcaacttggataaaataaatatataatgctctatttgttagagctctattaaaaaggaaacagattccatagatctaagtcaatgtttctccagaagcatgattttgtctgccaaaagaaaatagctctctttggccaaaatgcaaaattacattgctataagaaaagttacaagggaaagtttgaagacacaaatgatttaattttggctcaaaaactgaatttgcttaacactgctacataatttgggtgaagtttccttctgcccgtttttcttgacctagataaatacactttgagaaatccagatctaataaatgtcaaccaacattgacattgtaattgggtgattacaataaaaggtgagcagtttgttgtttattaataattagcttttgcaggtaatgaaatagcagggaagtaacatgctgctttaggactaaaaaaaaaaaaaaaaaaaaaaaaac

SEQ ID NO: 5122 - DNA, 2750 bp, Homo sapiens
  misc_feature (1879)..(1879): n equals a,t,g, or c
ggacgtcgtcgcctcagcgccggctcccggccgggccgcggccgccgaccgttgagccgccggctgagccgcctgctgaagtccctccctcaggaacccctccgccaccctccacctccgaaccgctctcgcggcggcgacccatgtgggggttcaggctcctgcggtcgccgccgttgctgctcctgctgccgcagctcggaatcggaaacgcctcgtcctgctctcaggccagaaccatgaacccgggcggcagcggcggcgcgcgatgctccctctcggccgaggtgcgccgccgtcagtgcctgcagctttccaccgtgcctggagccgakccgcagcgcagsaacgaattgctcctgttggcggcggccggggagggactggagcggcaggacctccccggggacccagcgaaggaggagccgcagccgccgccccagcatcacgtcctctatttccctggggatgtgcagaattaccatgaaattatgactcgtcatcctgagaattatcaatgggaaaactggagtctagaaaatgttgctaccattttagcccaccggttccccaatagttatatttgggtgataaaatgttcccgaatgcatttgcacwwattcagctgctatgacaattttgtgaaaagtaacatgtttggtgccccagaacacaatactgactttggagcttttaagcacctttatatgttattagttaatgcttttaatttaagtcagaatagtttatcaaagaaaagtttgaatgtttggaataaggactccatagcatctaactgtagatccagtccttctcatactacgaatggttgccagggagaaaaagtgaggacctgtgaaaaatctgatgagtctgccatgagtttttatccaccatcactaaatgaygcatcttttactttgattggattcagtaaaggttgtgttgktttgaatcagttgctttttgaattgaaagaagccaagaaagacaagaacatagatgcttttatcaaaagcataagaacaatgtattggctggatggtggtcattctggaggaagcaatacttgggttacttatccagaagtcttgaaagaatttgcacaaacaggaattatcgttcacactcatgtaacaccttaccaagtacgtgatccaatgagatcttggattggaaaggagcmcaagaaatttgttcagatacttggggatcttggtatgcaggtgactagccaaattcattttacaaaggaagctccttccatagagaatcacttcagggttcatgaagtattttgagattacaggtatattaatgaacttgttcagtggaagaacataagcacttttgagtgttataaattcagataatgggatgtaattcatagctgcattgtcagttttggggtatggggggaagcacacattcctaaaatgtgagtgtaatgtgcaatagtattttttgcttgtgaatgtgagcagttattaatttggattgagttagaattagttaatttgaaatctaacaaggtggtttgtaataatgctgaggagatataagacccttaaaatgaaagttacaacattgttcttataaaaggtaactaaaattgttactgttggaaataactgattttctgagtaatgttttaaactaatttggtgacattttaacagtaattagctattttgagtggaaatattttcatttctcttcaaacaaaagcaaaggtacgatgctgttttctatcattttggaataactgcaccctgccttttgtgtttttgtaaactccttgactcattctttcatgtgtcaccaagtacttttctcatragagtcamcatatatttgtttccaaatgtccacaagtgtncaatagtgtaaaggtggtttttaaaamcatagccaggtgtggtggcacgtgcctttagttccagctactcaggaggctaaggcagraggattgcttgagcccaggctgtgtggttcaccataattgtgtttgtgactagctactgcactccaacctgggcaacatagtgggacttcatctctaaaacaaaacaaaacaaaattacacttaagcactattgtttaatttttaattgtcagtttatcattattttgggtaagacattctggggtttcttgaatcttgtccaaaaaccagttgttttggaaaattgctttaaattgagcatatttatgtatattggataaaaatgtactacagagcaaatttcaaatttttcattatatcagtctttttgaaaggatcaacttggataaaataaatatataatgctctatttgttagagctctattaaaaaggaaacagattccatagatctaagtcaatgtttctccagaagcatgattttgtctgccaaaagaaaatagctctctttggccaaaatgcaaaattacattgctataagaaaagttacaagggaaagtttgaagacacaaatgatttaattttggctcaaaaactgaatttgcttaacactgctacataatttgggtgaagtttccttctgcccgtttttcttgacctagataaatacactttgagaaatccagatctaataaatgtcaaccaacattgacattgtaattgggtgattacaataaaaggtgagcagtttgttgtttattaataattagcttttgcaggtaatgaaatagcagggaagtaacatgctgctttaggactaaaaaaaaaaaaaaaaaaaaaactcga

SEQ ID NO: 5123 - DNA, 2752 bp, Homo sapiens
ggcacgaggacgtcgtcgcctcagcgccggctcccggccgggccgcggccgccgaccgttgagccgccggctgagccgcctgctgaagtccctccctcaggaacccctccgccaccctccacctccgaaccgctctcgcggcggcgacccatgtgggggttcaggctcctgcggtcgccgccgttgctgctcctgctgccgcagctcggaatcggaaacgcctcgtcctgctctcaggccagaaccatgaacccgggcggcagcggcggcgcgcgatgctccctctcggccgaggtgcgccgccgtcagtgcctgcagctttccaccgtgcctggagccgagccgcagcgcagcaacgaattgctcctgttggcggcggccggggagggactggagcggcaggacctccccggggacccagcgaaggaggagccgcagccgccgccccagcatcacgtcctctatttccctggggatgtgcagaattaccatgaaattatgactcgtcatcctgagaattatcaatgggaaaactggagtctagaaaatgttgctaccattttagcccaccggttccccaatagttatatttgggtgataaaatgttcccgaatgcatttgcacaaattcagctgctatgacaattttgtgaaaagtaacacgtttggtgccccagaacacaatactgactttggagcttttaagcacctttatatgttattagttaatgcttttaatttaagtcagaatagtttatcaaagaaaagtttgaatgtttggaataaggactccatagcatctaactgtagatccagtccttctcatactacgaatggttgccagggagaaaaagtgaggacctgtgaaaaatctgatgagtctgccatgagtttttatccaccatcactaaatgacgcatcttttactttgattggattcagtaaaggttgtgttgttttgaatcagttgctttttgaattgaaagaagccaagaaagacaagaacatagatgcttttatcaaaagcataagaacaatgtattggctggatggtggtcattctggaggaagcaatacttgggttacttatccagaagtcttgaaagaatttgcacaaacaggaattatcgttcacactcatgtaacaccttaccaagtacgtgatccaatgagatcttggattggaaaggagcacaagaaatttgttcagatacttggggatcttggtatgcaggtgactagccaaattcattttacaaaggaagctccttccatagagaatcacttcagggttcatgaagtattttgagattacaggtatattaatgaacttgttcagtggaagaacataagcacttttgagtgttataaattcagataatgggatgtaattcatagctgcattgtcagttttggggtatggggggaagcacacattcctaaaatgtgagtgtaatgtgcaatagtattttttgcttgtgaatgtgagcagttattaatttggattgagttagaattagttaatttgaaatctacaaggtggtttgtaataatgctgaggagatataagacccttaaaatgaaagttacaacattgttcttataaaaggtaactaaaattgttactgttggaaataactgattttctgagtaatgttttaaactaatttggtgacattttaacagtaattagctattttgagtggaaatattttcatttctcttcaaacaaaagcaaaggtacgatgctgttttctatcattttggaataactgcaccctgccttttgtgtttttgtaaactccttgactcattctttcatgtgtcaccaagtacttttctcatgagagtcaacatatatttgtttccaaatgtccacaagtgtacaatagtgtaaaggtggtttttaaaaacatagccaggtgtggtggcacgtgcctttagttccagctactcaggaggctaaggcaggaggattgcttgagcccaggctgtgtggttcaccataattgtgtttgtgactagctacttgcactccaacctgggcaacatagtgggacttcatctctaaaacaaaacaaaccaaaattacacttaagcactattgtttaatttttaattgtcagtttatcattattttgggtaagacattctggggtttcttgaatcttgtccaaaaaccagttgttttggaaaattgctttaaattgagcatatttatgtatattggataaaaatgtactacagagcaaatttcaaatttttcattatatcagtctttttgaaaggatcaacttggataaaataaatatataatgctctatttgttagagctctattaaaaaggaaacagattccatagatctaagtcaatgtttctccagaagcatgattttgtctgccaaaagaaaatagctctctttggccaaaatgcaaaattacattgctataagaaaagttacaagggaaagtttgaagacacaaatgatttaattttggctcaaaaactgaatttgcttaacactgctacataatttgggtgaagtttccttctgcccgtttttcttgacctagataaatacactttgagaaatccagatctaataaatgtcaaccaacattgacattgtaattgggtgattacaataaaaggtgagcagtttgttgtttattaataattagcttttgcaggtaatgaaatagcagggaagtaacatgctgctttaggactaaaaaaaaaaaaaaaaaaaaaa

SEQ ID NO: 5124 - DNA, 1201 bp, Homo sapiens
  misc_feature (1086)..(1086): n equals a,t,g, or c
  misc_feature (1161)..(1161): n equals a,t,g, or c
  misc_feature (1176)..(1176): n equals a,t,g, or c
cggcacgagcggctggcagcacgactcgcgtaccgtgcgccgattgcctctcggcctgggcaatggtcccggctgccggtcgacgaccgccccgcgtcatgcggctcctcggctggtggcaagtattgctgtgggtgctgggacttcccgtccgcggcgtggagggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgmacgtaatccagtatttggkaaagtaatccaktttgaaatgtgragrtgtattccggcagaatagtgagtagaatgacagcttactatacagaaggcmaaaataggactctcaggtaatagtttaaggaaacccttgattccttatgatgatgtttaagaaaggttagttttctgtttctttgccagttttncttctaggagtccatagccagggaaagtatgtgaaccagaattggttagtgtgaccccctccaagtagccagtgntgggaaataagggtncaataccttgatgtttgtgatctct

SEQ ID NO: 5125 - DNA, 890 bp, Homo sapiens
  misc_feature (780)..(780): n equals a,t,g, or c
  misc_feature (788)..(788): n equals a,t,g, or c
  misc_feature (820)..(820): n equals a,t,g, or c
  misc_feature (842)..(842): n equals a,t,g, or c
ggaacttttactggtaaagctcacaaaagctggcgctccaccgcggtggcggccgctctagaactagtggatcccccgggctgcaggaattcggcacgagatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgaatgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgktaccacagagaattctcttcaaattaagatatgtcattagaatgcttggaccagtcaatcttttgtacttatttgaaaatataggaacaatttarcagctgcaaatatgcccaagctatttttaatagrtatactaaacttattgntgacaaanttcagccttccttaattttttttttttttggnaattacctataggcttaaaagncattccgtggtggtctaagattaattaggaattccgggaatgaaagtt

SEQ ID NO: 5126 - DNA, 1270 bp, Homo sapiens
  misc_feature (378)..(378): n equals a,t,g, or c
  misc_feature (1192)..(1192): n equals a,t,g, or c
  misc_feature (1250)..(1250): n equals a,t,g, or c
  misc_feature (1257)..(1257): n equals a,t,g, or c
  misc_feature (1266)..(1266): n equals a,t,g, or c
acccacgcgtccgataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgncagaagtttctagtaagagattataactccatttacaggttckgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagargrgacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactggtacctggttttaaacctanttttattttttggctcccatggggcttaatgtggaaaggttcccgccggtaggggggncccgtcngtggggtancctg

SEQ ID NO: 5127 - DNA, 506 bp, Homo sapiens
  misc_feature (415)..(415): n equals a,t,g, or c
  misc_feature (463)..(463): n equals a,t,g, or c
  misc_feature (465)..(465): n equals a,t,g, or c
tcgacccacgcgtccggaaaaaaagagaaagggtggaaaagagggattccagagtgccaggcacacagattttctggaaggtttacatgaggactgctgtggtttgaatgtgttccccaaagttcatgtgttggaaactcaacccctaatgcaacagtgttgatcagtggaacctttaagaggtgattaggtcatgaaggctctgccctcatgaatggatgaaggtagggtgggttagttatcttgggagggggttcctgataaaaggatgaggttggcttcctccctttctgtctttccccttctccctstcacatgtggtcactctsttgcccttttaccttccagcataggacaacacagcgagaccttcaccagatgcaggcccctcactttcccagtgttcagaaccatnaaaccaatgaacccttatgaaatcacccagttctgtggtattctgttnanagcaacacaaacaggactaaagacagggacactccatggag

SEQ ID NO: 5128 - DNA, 1205 bp, Homo sapiens; identical to SEQ ID NO: 572

SEQ ID NO: 5129 - DNA, 1269 bp, Homo sapiens
  misc_feature (36)..(36): n equals a,t,g, or c
  misc_feature (45)..(45): n equals a,t,g, or c
  misc_feature (1007)..(1007): n equals a,t,g, or c
aaaaactaggggttcaaaaacacaaccccggtttantcaccctantagccaacgggatgggcacccaacaccccactgccttccagcctgaagctggcccagagagagagagccatccccggaaaagctggaaccctccccagaaggccctgaagacctgcaggtacccacactgtagtcccactgaagaggagggccccaatgtgagggggaaaaaaccactgaggaaacataatatttgtgtatttttaataagatatttaatacgtgttcaggtagaagtaggtacaatgacagaaaataaggtagaggaatgtgctagacaccacagatacgtaatgatggacaataaatgacatgatgtggagagttcacccacacatgcagacttcttatgttcacataaacatttatctgcatgcatcacccagtagagacaaactgcacttacactgtgaagtcaacgaggagataaagtaaaaatcaaatacttatggagagagtcagtctctccatttagtgggaaacccttcagaacacgcacacagcatctcccctcccttctgaataccatccatagcctgcagcagtagatggcaaatcacagcctgggccacccttcccagaatgtcaaaaacatggacatgcagaccacagaattcaccagatacccaagctgggtggtgcgaggctctgaaagacatgcttcaaataagagggactagaaaactccgcaagggagcaacagggatcagggattccaggaggatccaggggcctgtgcgaagagcaagcagtgagcagatgtgtgtgtcagtgattcggtggcatgaactcaacaccatctaatacagcagctcacgtttctttgtgcatcagactcacctggggacttgttaaacacagattgttgggtctcactcctagagtttcttcttcagtattctggggagcagcctgtgaatctgtatttccagcatgattttcaggtgctactgatactattngtccaaggaccacactatgatctaatttaacatcagattaggggaggaactaaggagcaaagaagcaacagaatggacctgaaccctgtacgggcttctctgtaaactcctcaaacataaaagccttcgagacactcaaagagcatttacagcatcatgtctacaaatacaaggcaccacgcagggagtgctccatcaagtagagagaagagctcactgagtgtccctgtcttagtctgtttgtgttgctataacagaatac

SEQ ID NO: 5130 - DNA, 2248 bp, Homo sapiens; identical to SEQ ID NO: 4458

SEQ ID NO: 5131 - DNA, 808 bp, Homo sapiens
  misc_feature (230)..(230): n equals a,t,g, or c
acccacgcgtccggttaaacaaagggaatgacgatatgggaaagaaaatacatttggatgttacagatatgtgtgttcctggagcccagggccaagccctccctgggggacttggattggtgatctctctccttggccccaacctgacatcttttcttgtccttttaggaatgtctgatggaaattcctcctaacctggggtcatactccatttcattctctgggctcantgagaaggaaaatttttttttaagtaatttactgaaaacccagatcacaccatcataaattcagataggtgcaattctgcccacaatgaaggcaaagtgttacactaatttgaaaacagtttagcctcttattcccccaaacttcattcttgaattttgtcattttttgtgggcaagctgtgggaaaggggcacaaaagtatcactgaagtattttttcaaaaaagaaaaaaggcagtcttcctctactaatgagaatgcaaaatgttgaacaactgtaaaatgttttcaccctgcttttagacataaagctttaaaaaactgtgaggtcttttatcacttccccattgtatatgtaatatggctccagataattactctgccacggggagaaaatcttccataactctcccctatatatatgtatactccaccaccttatcttgttatgtcatggtggtgggagtatttatmccacagaaacaggcaaatgatacaaacctgggcgacagagcaagactccacttcaaaaaaaaaaaaaaaaaaaaaaaaaaaaaaaaaaaaaaaaaaagggcggcc

SEQ ID NO: 5132 - DNA, 1183 bp, Homo sapiens
acgcgtccggatttttatctgcctttttttgtctggcagtcaaactttcacagtccctgttaactcctgtttcttcttaactttatttcctagcagtaactctgtgcataatccatattgttcagagtttcactaagtaagatgtaatacagcccactgctgatttactgatgaaagaaaatcacttataagatgaaccctgctgtaagacagagatgtctcttgttttgttttcagcagaagctgatcctgtctcattttttcctgctacaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggttggtttgtggggttcagtccgctccctgctgatgattcttggcttaggttctacaattctgaaggagcattattctggcattctacctgttaagcatctatgctgtgcagtagcaactggtctctgtcatcagccagccagcaacagttgctttcccacactggcatcatctgggattccttgtctaaatgtatcccatgactcccattatcccctggaaaaagttaacaacttgcttggcccctcagaaccttcaagcgtgtgcttctggagctatgcctcatgcagggtccacatcattgcctgtgtgcaagccacatggacacctggagcacactgtgtgccctgtgctttccacaccctgtgcctgtacacctgcccctccctgtgctcagcatgtccgggcccggctagttcctcctagtcactcagtatgcagtgtagcagccacctactccaggaaggcttccctgcccctccagtaatacacattagaaaaccctctgtggggcttctggaaaacttggtgtcagcctgcatcatagcagcttcgacagtgtttctcaaactgtgctttgcagagtcttctatgttccaaggagacttctctgtggctaccgcaagttgtggtatctcttctgtgcttagcttcattatgagatttcctttgaagaaggatttccaagagcttgaaagaagaaaaaaaaaaaaaaa

SEQ ID NO: 5133 - DNA, 1430 bp, Homo sapiens
aatttgaccctacttccctctcagtcctaagggcctatctttcatcactaggttgaattatctcccatgtttgatttgcctctatctccctatgggcttgcaacaccatgacgggcacattgcaagtgcacttakacaaatgagatcagatgacctggggaacgtggcttgtacacacctttctgtgttctgtagcatcagctaagaccttaaaatcagtaagaaagtatctgtctctctgttcacccataggaagcagcttcgtggtgagtgaagggagctacctggacatctccgactggttaaacccggccaagctttccctgtattaccagatcaatgccacctccccatgggtgagggacctctgtggacaaaggwcgacagatgcctgtgagcagctctgcgacccagaaaccggtgagccatgggagccgggatggggatagaaggtgggagaggctgggttgaaagaggcattgtgctccctctacctaaagaaccatggrktctgagccattgacaagtggctgaataagaaggcccatcaatctaataaacactaatgtatgtgctgccattgcctttcaaggggggaaattcttagagagccacagactctcagagtaagaaaggaccacagagaacatctggcctagctccagacaagcaaaatgtctgcacttcagatatccctgcattcagagcctatcttcttggtactagctgggtgatcttgagcaagacactgcttacctttcagtacaagagaatgaaaatagcaccaacccacaaaactgtcattaggattgaatgagaagctgtgtggaaatctcacagcatattcattaattcactcaacaggtatttctttagtagccaggcatatttttaggtattgggaagacagcagtgatcaaaatatgcaaaatctccaccctcatgaagcttacatgctagtggggtagacactaaacatgcactgtggaatatggtagccactagctacatgtggcattttattttaaattaattgaaattaaataaaagtaaacattcattttcccagtcataccacccagatttcaagtgttccatagccacacactagcagctacattgttgcacaacatagmtatagaatatcttcatcactctgaaaatttctcatgggacagtgctgcagtggtcaaacaagcaggtaaattatatgactctgttaggtgatgatagatgccggtgtaggggaaaagaatgatgtacaaagcatgtggagtgctaagctgggagtttgggtggagtttcattatacagaaagtggtcaggggaggcctctctgaggtaagaggatcacttgagcctaggagttcgagtccagcctggacaacatagcaagatctcatctctaaaaaaaaaaaaaaagggcggcc

SEQ ID NO: 5134 - DNA, 680 bp, Homo sapiens
  misc_feature (547)..(547): n equals a,t,g, or c
  misc_feature (627)..(627): n equals a,t,g, or c
  misc_feature (650)..(650): n equals a,t,g, or c
  misc_feature (658)..(658): n equals a,t,g, or c
gcgctgagggaggggttgcttcgtccccctggctctcacccacctgtctcccacccccgtgatgtgactcagctgctcaccctactagagtctctttcccgttcctttgttctgtgtctggccgtgggatgggacacgggcggaggctgggaaggcacctgctggctcttcctgtcaccctctccgagcggtgtctaggctccccggtggagaatgagacacactcgagggatgggacagagctgcctgatggcagccgagagccaagcagccctagacgagtgagtgagtcccgagtgaccccggcgaggacagaagagccacctgctgagcccagcctgacccctgacctgcggsttgataacagcagagggagcctctaacctccctcttccgctggcgttgggaaacagccatggggctcacggggcctyctcggaggacctatgccgsctctccatcactcagctycctcagcgcggggaggaaatgaccgctmakttctattatctccmaagctgaaggatgatctcaagttttatcggcnaggaaactcatttgattttaaatgattttcggcctggaaagatttggctcaaggacgcttgacctggctgggcagagcanagagaccggggtgtcctcggtgntaaaaaanggggttgtgccgcaaatgtgcc

SEQ ID NO: 5135 - DNA, 655 bp, Homo sapiens
  misc_feature (590)..(590): n equals a,t,g, or c
  misc_feature (594)..(594): n equals a,t,g, or c
  misc_feature (616)..(616): n equals a,t,g, or c
  misc_feature (655)..(655): n equals a,t,g, or c
gattaaaacggakaatacagatgcaagctggaatttgaatgtttctctttctatgattgggcctcatggatatatctctgcatcagattggcccctaatgattttttacatggtgatgtgtattgyttatatattatatggcatactctggctgacgtggtctgcctgttattggaaagatatattaagaatccagttctggattgcagctgttatttttttgggaatgcttgaaaaagcagttttttatagtgaataccaaaacatcagcaacactggactgtcaacccaaggcttattgatatttgcggagttgatttctgcgattaagaggacgttggctcgccttctcgtgatcattgtgagcctgggctatggcattgtgaagcctcgyttaggaacagtcatgcaccgggtgatcggactggggcttctatacttaatctttgcagctgttgaaggcgtgatgagagtcattgggggttctaaccatttagctgktggtcttgatgacattattttagcagttattgactccatttttgtgtgggtctaggatcagacatgccttggaaaaatctgctaacagnctgngggagccctcttcttcaccagnacacagaccccaagggagcttttgcatggacagggccan

SEQ ID NO: 5136 - DNA, 1556 bp, Homo sapiens; identical to SEQ ID NO: 2763

SEQ ID NO: 5137 - DNA, 1643 bp, Homo sapiens
  misc_feature (8)..(8): n equals a,t,g, or c
  misc_feature (12)..(12): n equals a,t,g, or c
  misc_feature (753)..(753): n equals a,t,g, or c
ccactatngggnacaaaagctggagctccaccgcggtggcggccgctctagaactagtggatcccccgggctgcaggaattcggcacgagagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggnaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcgcacacacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttaaaaaaaaaaaaaaaaaaaaaaaaaaaaaaaaaaaaactcga

SEQ ID NO: 5138 - DNA, 805 bp, Homo sapiens
atgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctactggcggtgtataccaggcagtgtgccagtttaaaaagatgaaaaagaataaaaacttttgaggaacaaaaaaaaaaaaaaaaaaatt

SEQ ID NO: 5139 - DNA, 864 bp, Homo sapiens
  misc_feature (23)..(23): n equals a,t,g, or c
gggttttttgtttttgttttttnaggggggagggggggtttcccctcctttgccccagacttctctttgaacacaaatgcattagccttgtggctagaamaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaaaaaaaaaaaaaaaaggggcggccgctctagaggg

SEQ ID NO: 5140 - DNA, 1157 bp, Homo sapiens
gttaaaaccgcatctgtagtattattaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagctccaggtcttcctctgcctgctccacaccactcgccgctgtccctctgcactccctgccttggtgcgtgtagtcccagtgtctcactgccaaacctcttggttacsctgcggggatctgtttctttgcctgagatccttcctgaggagcgtccattcctctggagtctctccttgtttggaacaaatcgcttcgcctttttctacttgcctgctgaagctttggagcacttgtgattgcaagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatrtatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataa

SEQ ID NO: 5141 - DNA, 803 bp, Homo sapiens
  misc_feature (226)..(226): n equals a,t,g, or c
  misc_feature (695)..(695): n equals a,t,g, or c
cagctgcccacaaggtgggctcctgggggagggtcatccctctgagaagagggcggcaccaagacccacacacctgaaaaatgtggtacttcatgtcgctgatctcgatggtcttgctgctgtccccatcctgttctgatttattggtcattagtgtcttgaacctggagcaaaggagacaaagcaaggtgggttttgaaccttttacttcaccactgtgtggcgnatggcaccatctgtcacctgaccggctaccacaagacggaacattttaaaaattactgctgtgctcctaaaataattttcagcaagtgccattttacaccatcttaggaagacatctgagctgagcccaattctgtccccaccacccaccctacaagcgacctgacgcctgtggccagaatgctgactcttcattccaggatatttatgttttctaataataaaagcaataactaggccagaaagaacaccacctcagagcccccctttcctgctgccctgggtccaccccgtctcatcccgctgtggggcgagtggggctctgctgcaatgtgactgcagtctgaggggcagargctgcaggktacagccccagcgaktcactctctgtcacctggaatctgaaacaaggtgcttctgtgcccctgggctgggagtttgttatctgaggctgcctacctgttagaacntgtcaccagcaggactttatgtgcataaaacagctttccttccaccaaaaaaaaaaaaaaaaaactcgagggggggcccggtacccaattcgccctatagtgagcgat

SEQ ID NO: 5142 - DNA, 404 bp, Homo sapiens
ggcacgagttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaacgtcaaatttctggacttttttctttcaatttttaatttttaaagtttttttggtattaaaaaatctattcacaagccaaaaaatatataaaatatacagcgaaaagccaaaaaaaaaaaaaaaaa

SEQ ID NO: 5143 - DNA, 1035 bp, Homo sapiens
  misc_feature (1032)..(1032): n equals a,t,g, or c
  misc_feature (1034)..(1034): n equals a,t,g, or c
agaggcctggctgcgttgccctatctccgtctccgccacccacttagcgttttaggcatcaattaccagcagtttctccgccactatctggaaaattacccgattgctcccggcagaatacaagagcttgaagaacgccgcagttgcgtggaagcctgcagagcaagggaagcagcgtttgatgccgaatatcagcgaaatcctcacagggtggacctcgatattttaacctttacgatagctctgactgcctctgaagttatcaaccctctgatagaagaacttggttgcgataagtttatcaatagagaatagttaggtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaacgtcaaatttctggacttttttctttcaatttttaatttttaaagtttttttggtattaaaaaatcyattcacaagccaaaaaatwtwtwaaatwtwcmgcgaaaagccaaaaaaaaaaaaaammagggggggccgggccccatccccccaagggggtccngnt

SEQ ID NO: 5144 - DNA, 1052 bp, Homo sapiens
tcattaacttcagacaacatcataaagcaatgatagctcttttctttgtgaccacaaycttaacttgagctttgctgggtgttttgcacataacaatgagggactattagacataacataattttcataggtcattgccctgtcaatgatagagaagataattgcmagakagttwatttctggtgtgtgtatatgtgcacaaatgtgcagggcctctactttgcaactggaatttatagactaatgataaaatatatccctttaaatatacaaatgacaattgacttcaaactttcccaagcccacatagaaattccctgaaaacatataaaatattgagttcttcaacctcagcactattgacattttggaccaratagttctgtwtgtkaaaggckgtctttgcactgtagaatgtttagcaatattccaggcctctatccacctgataccgggcctgtatccccctgatactggtagttcttttttcccccatcacaaattgtgacaacccagaaatatctccttatacctttccagaatgttttccctgggggacaaaaagcactcccattgaaaaatccactggtcccaaatggttaaaaattggttcccttcccattccttttaccaggtttggggccaagcccccttcccttaatttccctcccgaaatgaactgaaacccaactgtwactcttaatgaaatattgaaggkttgaagctttaaaaaaaaaaaaaaaaktacagcttggctgggtgcagtggctcaagcctgtaatcctagcactttcggaggccaaggtgggcagattgcctgagctcaggagttcgacaccagcgtgggcaacatggtgaaactctgtctctactaaaatacaaaaagttaacctggcatggtggcaggtgcctgtagtcccagctactagggaggctgaggcaggagaattgcttgaacccaggaggcagaggttgcagtgagccaagattgccactgcactccagcctgggcaacatagcaagactctgtcaaaaaaaaaaaaaaaactcga

SEQ ID NO: 5145 - DNA, 624 bp, Homo sapiens
  misc_feature (98)..(98): n equals a,t,g, or c
  misc_feature (151)..(151): n equals a,t,g, or c
  misc_feature (522)..(522): n equals a,t,g, or c
  misc_feature (529)..(529): n equals a,t,g, or c
  misc_feature (562)..(562): n equals a,t,g, or c
  misc_feature (573)..(573): n equals a,t,g, or c
tgcagtgaaactccttgtccagatccctttcctggtgtccactcctcagcaaggcagagcttgggggcaatgcaccggggaaccctgttactgtggancaagcctgggtcggcatctcaatctcatttctcatgaccggggacagcttganccagctgcttacactcatgcagccttctttcaccatttttagagttgtgaggagttgatggtgtaacgtaactcatccctccctggctgtatgggacagtagcatacctgaggatgggttaggattgctgagatgggctggagccggggcagggggcctccagctaagagaggcctcctgagcttacctcatttggtctcagggctattctcattttccagatgarcagtgatgtgaacwatattggaaagcatcaaagaaatggatgtaaagtgtctggcacagagtgagtgctcagtgactgtgggtgccctctcgtccagctcctctgaacatgcctttctcgcggcacttatgagaatgtgccatcnctgtttnctccctgtttgtccccctctacatgctaaattntttaggcccanggactgtgttacactcatctccatagccccaggcctagcagggtgcctcct

SEQ ID NO: 5146 - DNA, 657 bp, Homo sapiens
  misc_feature (42)..(42): n equals a,t,g, or c
  misc_feature (494)..(494): n equals a,t,g, or c
  misc_feature (507)..(507): n equals a,t,g, or c
  misc_feature (532)..(532): n equals a,t,g, or c
  misc_feature (620)..(620): n equals a,t,g, or c
gacacctcaggggcatccaaggtcatccacgacagcctgatntgggcctttcagctcatgactttcacctgggattggttctcatttctaagtggcacttcctcccccgtggagctttctggggacacttcatggaaggtgcgttttattttcatggagagcatcggggtgagtcttgagagtgaggttaggactctcaagagggacatggcagggatgtctggtggcagctgaagcttcagccccacacacaggaccagaagtaactcgcagcacagccatatgccaggcccgccaggagccaacactgcccctcctgccctcctttcctgcatttggttccctccctctctgtgggcatcctccctcttccctacacccagaacgtggaactgggaagtgcccggcacagaccccatgccctcgtccttggcatgagctcacccttcttaaagaaaacttgcagtgcagtgaccaccactaaaaagcatggngaagactgggcangagacatgatgttttcatcctgagnttcctcagcctgttgctggaaactttagggagtgattcttccatgaaatcatcatccattcattcagcaaatactgaggacctactangcaggaggcactttgctaggcctggggctatggagat

SEQ ID NO: 5147 - DNA, 1021 bp, Homo sapiens
  misc_feature (8)..(8): n equals a,t,g, or c
  misc_feature (908)..(908): n equals a,t,g, or c
  misc_feature (937)..(937): n equals a,t,g, or c
  misc_feature (987)..(987): n equals a,t,g, or c
  misc_feature (1014)..(1014): n equals a,t,g, or c
  misc_feature (1017)..(1017): n equals a,t,g, or c
  misc_feature (1021)..(1021): n equals a,t,g, or c
caggaatncagccctgtcatccatgtgcttccggtgaatccagggcacagccaaccagcaggtgctctgatgacagggtgaggcctttcagacaaaagggacagcacacggaattattcttgactctttctgtgctcacagtccacatccagtccgtccatgaactatgaagctgtttccactttggggccatgatgaataacgctcctgtgaacacgagttttttgtgatgtgatgttttcacttttcccgggtgtgcagctacgagtggagttactgggtcacatggtgcctctgtgattgtctgcacatactccatattttacttattaattttagttctatcctatcctgttttctcacctttgctaaaacgcaaacctcatgaaggcagcaaattgttttctgttttgtttgctgctatatctccagtgcttagaaaataagtcctcagtaaatatttctggaataaatgactgaataaatgtacagaggcckgagggtgaaacatccttttgtattcaggaagctgcaagtcactcaggatgactggattgtaagatacaggggcttaaagggcaatgctgaggttgtgcatagggaacaggtgaacttaccaagaaccatgggccttaggcatgctctcttaaccaggagagcaaccagatccatgggggcaatttgtgttgcaggttgtgggattccagctcaagttagcctaagcaaaagagggattctattggttcccaagacttaagttcaaggtaagcagttgcttcaccccctgtgagatccagagatgaagatgattctctttctccctcctcttccctttctctttctctcagtcccttcttttctctccctctctcctgtggcccctcctccactttccactttcctgaatncctttgattcctgcctgagttctctcctnaaagtgacaaaatggtcagtggaagttccaggctttcatcacccctgagnctttgcccctagttacagaaagggagnctncccn

SEQ ID NO: 5148 - DNA, 1251 bp, Homo sapiens
  misc_feature (22)..(22): n equals a,t,g, or c
  misc_feature (48)..(48): n equals a,t,g, or c
  misc_feature (72)..(72): n equals a,t,g, or c
  misc_feature (121)..(121): n equals a,t,g, or c
  misc_feature (1218)..(1218): n equals a,t,g, or c
  misc_feature (1223)..(1223): n equals a,t,g, or c
  misc_feature (1240)..(1241): n equals a,t,g, or c
  misc_feature (1251)..(1251): n equals a,t,g, or c
gatcctatcctgttttctcacntttgttaaacgcaaccttcatgaagncagcaaattgttttctgttttgtntgctgctatatctccagtgcttagaaaataagtcctcagtaaatatttntggaataaatgactgaataaatgtacagaggcctgagggtgaaacatccttttgtattcaggaagctgcaagtcactcaggatgactggattgtaagatacaggggcttaaagggcaatgctgaggttgtgcatagggaacaggtgaacttaccaagaaccatgggccttaggcatgctctcttaaccaggagagcaaccagatccatgggggcaatttgtgttgcaggttgtgggattccagctcaagttagcctaagcaaaagagggattctattggttcccaagacttaagttcaaggtaagcagttgcttcaccccctgtgagatccagagatgaagatgattctctttctccctcctcttccctttctctttctctcagtcccttcttttctctccctctctcctgtggcccctcctccactttccactttcctgaattcatttgattcctgcctgagttctctcctcgcagtggcaaaatggtcagtggaagttccaggctttcatcaccccttcagcctccagcacacccagaaaaaccagggtgcccactctttcccccacatccgtgggcatctcscggrrggtcttwratraaccccagttaggtctgaatcttgtgctggatgagtcacagggacactatccagccacagtggctggtcccagtagttgagggaccctgagaattgtgtggaatgtggtgatggggagtgtgcatgtgggtgcacacatatagggtatttgtgtgtgtgcaccgtgtacatgcaggggtgtgtgtatgtgtgtatgtgtattagggtctgggtgtgggtgtggggtgtgttcagggagtgtgcatacacgcatgggtgcctgggtatgtgcacgtgtttgtgtgtacgtggagtgtgtgtttgtgtgtgcatggtgtgtgtgcatatgtatgcactggtatgtgtgcatacatggggtgtgtgtgcatatgtggaggtgtaggtatgtggggagtgtgtaggtgtacatgtatgagtgcatgtgaatgtatgtgaaggtgtgtgtgtgtgtgtgtgtgtgtgtgtagcagtggggtggttgcctaaacaaaatggngtgtntccttccgttccccccnncgagaaggan

SEQ ID NO: 5149 - DNA, 1581 bp, Homo sapiens
  misc_feature (1490)..(1490): n equals a,t,g, or c
  misc_feature (1495)..(1495): n equals a,t,g, or c
  misc_feature (1503)..(1503): n equals a,t,g, or c
  misc_feature (1528)..(1528): n equals a,t,g, or c
  misc_feature (1541)..(1541): n equals a,t,g, or c
tcctgacctcaggtgatctgcccgcctcagcctcccaaattgctgggattacgggtgtgagccactgcgtctggcaaatttttggcagttacaaataaagctgctattaacatctctctctaagtttttgtgtgcatgtaagttttcaactctgggtaaataaggagcaggattgctgggtcatatggaagtgtgtgtttagttttgtaagaaatcgccaaactgtctttcaaaggggctatacccttttgcattcccaccagcaatgaatgagagtttctattgctctgcattcttacctgcatttatagtgtgttggattttggccattctaatagttttgacttgcggtttccgaatgacagattatattgagcatcttcatgagattctttgccatctgtatatcttttttggcaaagcatctatttcaggtctttcaacatgatccagcagttctgctgcttgatatttacccaaggagttgaaaactttttttttttttatattctgacattcttctaatggattgtgatttgagttaactttgtagggtggggtggtggtatcttagaaatggaactctttggaaataatacaggggggtattttcttccccctaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggtaaatatggtggaattacaggcatctaaatcagactaacaaatttagtcattttagaatctcaaaatagttttacaaattggaggagactttggaagtccatggaatccattcaaactaaaaccttttggttttagtgatgttggcagttttctaagtaaaaatgaaaaataattgaatatctgcatctttaaataaaattatttgactgyctgcatggggctttctcttgkccttcccacattaatgataaatgatattccaactttaaatgaatcataattgkatgaaagtcctatttttatattgacttatctaattttttaaggctatggaagaaatgaatggcaaagacttggagggagaaaatattgaaattgtttttgccaagccaccagatcagaaaaggaaagaaagaaaagctcagaggcaagcagcaaaaaatcaaatgtgagtgaaatttgtatacttaaaaattgtataaattttaatatttatacactaattggaaaataacaggtgttgatcagacttgttaaatgcataacatctctttaaagaagacttgaacgtttgagagtcatagggaaacaccagtgatctaagtgtttattgaactcttactatgaaccatatttgtgaaaataatcagaattgkaaataactggaattttggkaaattggsaagatgaaaaatstgtctagctttttttttgntttgnatttgggngacagagtctcactttggcactcangctggagtgcagnggcactctttcggctcactggaacctccacctcccggggt

SEQ ID NO: 5150 - DNA, 1432 bp, Homo sapiens
  misc_feature (6)..(6): n equals a,t,g, or c
  misc_feature (65)..(65): n equals a,t,g, or c
  misc_feature (123)..(123): n equals a,t,g, or c
  misc_feature (185)..(185): n equals a,t,g, or c
  misc_feature (205)..(205): n equals a,t,g, or c
ccttanaaaaaaggggtaaattggttccttgaatggtgaagacccaattattcccctgtccaatnctattccaaggttaatttttctggttgattgcccctgtttggaatttaaaggaagagnatgctttctacatatttcgggttccttcataatcagggaattgatccaagttctagtttctncagttaattgtccagttggncaagttggcaagctctgaacctcaatttcttcagttctaaaatgggatcagcaaaattatgtaatagctctggattatgtgattatccaagtgacccatgcttgttctgggaccaaagaaaatatactttgtaggtttgatgatagtgtaaatgaaggaagactacaaaaagagttagttttaatgctctatatttcaaacacctggatatactaaacagtgtaaaataacttctttttatttctttcagaagmcgatatatggttaatttattaaagtagaatgtaagtataggagattatattagataatgtgattagagcagttacatttggtacttgatagagggrgwtmctaawtrgaaggtggaggatgtcagtatayctgttaatatttgaaaaggagtmcaaactaaaagggatgattgcakgttactttcgtactttaacttgctacagtctttttttttttttttttaagttttaactaagcacgtattcctacataattctcactgtattcctgtgagttaggtactctatcccttagtttgaaatgaggaaactgaggctcagaagtcaacttccttggggtcattcacatagtaagtagtggagttggatttgaactaaggtagtctagtctcccataattttccctcttaaccactataccaggatttctcatctctgtcctcctgacattttgggctggataattcttggtcttgggggctgccctgtgcgttgtaggacttttagcagcatccttggcctcttcctgctagatgccagtagcaccccctttctcagttatgaccgtctaaaatgtccccctggaaagaggtggtggcaaaattatccctggtgagaactatttagaaatagaaaaggatgatctttccatcatttcctcaaaacaataaaccagcagagcacataaaaggtctaaggacctagtgaaccggaataacatttttacgttagtcagttggaacaggggcctttaataattcaggataaaataaggccgggcgtggtggctcatgcctgtaatcccaccactttgggaggctgaggtgggcagatcactctaggccgaggtgggtggatcattcgaggttaggagttcgagaccagcctggccaacatggtgaaaccccatctctactaaaaataaaaattggctaggtatggtggcacatgcctatagtcccagctactcgag

SEQ ID NO: 5151 - DNA, 1300 bp, Homo sapiens
ggcacagtgagacaggagcccaggggagaaagacagaaactaagactcaaggagcaacgcaaagcaaagtcaaggagtcaagaccagagtagctgagcagaggccaagaagggtctgagagggctgtgcagcagcaatggccctaaggatgctctgggctggacaggccaaggggatcctaggaggctgggggatcatctgcttggtgatgtctctactcctccagcacccaggagtctacagcaagtgctacttccaagctcaagccccctgtcactatgaggggaaatattttaccctgggtgagtcttggctccgcaaggactgtttccattgcacctgtctgcatcctgttggcgtgggctgctgtgacacgtcccagcatcccatcgacttcccggctgggtgtgaggtacgtcaggaggcaggaacctgccagttctccttggtgcaaaaatctgaccctcggctgccctgcaaagggggagggcctgacccagaatggggctcagccaacacccctgttcctggggctcctgctccccactccagctaaactcaactgatcatccatctgctgactgctcactgctgctgccacttccagggaaaccactagcagctgccaatgtattctgaacaaataaattaatgctatagctgaaasccgactctcactgtccacgacattggaccccaggtggaaaaagtgggtcccattagagtccaggtgctgagttctcagtatccggaagaactagcaccagggtgggccagtttcagatggttatggtgctggtgctggggcctggggcagcatatgaggccagggtggggctagtaggcagcaccttgatgggcaggtcccagctgaaggtgtctacaggtacttgctcaggtcctgtccaggtggtaggttcgggctgttccacagggggtaggagtaccaatcctggttctcgggacgttacaaattcaaatgcmatctccacttcaggacacaatggctgtacagaascctggggtgaagctraragggwttggraggraraagctgttcyagttgtatktwggccagattyctsgtsccggcgtgaagtaaattttgaacaaaggggaccacccctgcccccagttcgcgttgtaattaaggcgtacacgctccttcggttggtaactgaattgaaaactgcaaaaaccaaggtgtccttccctaagttttaaggtccccacaagtccccgcccaagtctgtaaacaaatttgagatggccaaaaggcccaactttccccccgccatca

SEQ ID NO: 5152 - DNA, 772 bp, Homo sapiens
  misc_feature (718)..(718): n equals a,t,g, or c
  misc_feature (732)..(732): n equals a,t,g, or c
  misc_feature (747)..(747): n equals a,t,g, or c
gcctgacttgaggttccatatatcgggaggtgggaacctgggggtatgcagttgcccatgaagattcatggaggggcctcgcgcagacagctgacgtccgctgtgtggcctcccctgctttgtgcatgccagcctccttgctaccatgtgtgttcatgcgcgcttgtgtgtgtgtgtatgcatgcgcacacatgtgtgtgtgtcttgctttctcatacctcattggctgcataaaatgtaggcctaaggatgaaggggaagattacacccaaagcctggctgtgacagcttctgtccagaaaagctgtgtttgggctcagaattactcactacattcatgcaatacatatgcaagcagggascagagagctttatcaccggggctacacaacagaagggaaaaacagttatgtggagagctggtgacctgacacgggaagcttgagggctgcggtggggaggtacagtctccccactggattgtgctatcagagaggcggctgacagccccagatccatcttgaaaaacccagaaacagccatgtggactggtctatggagtctgctcacttggatagcttgggagggggggggtgctgcgacttgctcaccccaaatacgaggtataaaaccaccacttgttatcgagatcatgactgtgcctgggattaagaccaatggtgggcacctatgggagaargtcagcgatgcctcccanctggggcagctcanggcctctccctgtancacttcatgtgtaagtggcctgaga

SEQ ID NO: 5153 - DNA, 920 bp, Homo sapiens
  misc_feature (16)..(16): n equals a,t,g, or c
  misc_feature (760)..(760): n equals a,t,g, or c
tgagttgcttggacantttgtgtcagtgcacagtgatgacagtttaagatctgcyttcaggctggmacatagatcccttgaaaacatgtactgagtgagtgcttcttggaggccaggcytccccagtaccacatcttaaggagacacaggccttgaccaagagttcatcattgaatggggcaggtggggagaaggaagtgagcccaaatcctggtctgatgaagagctctgtgctatagggccaagcacagggaagccctggaaccctgtccgggcaccactggggaggcttctccatccctgagctgcctcctggaaattgcggcgaagccagggaggaagagtacttcagtggcaaggctgctcccagaggggcctccctctgaacctgggcttccttcaatagctctttacctttgactgagaaacaggaataaatgggttgttcccaggttaagaaaatgagaaaaatgagatgaaaggagcaagtcctttctggccactgcaatgcgtcgcctttcttcctgactcatgacagctttacagtcactttccaaaccaggaagacaccgtttggggcaccgtttgggccaacagagaatctcacagttgctttctttccttgtgcaatcatttgatatcccattctcatcacccagcctgactgtggcgctacttgggattttgtattttatgccatatttggcaaaaaacgttttacctctgctgccatgagaagggctgcacaatgacacagagnccaccacaggcctctggcccagctgaagccaaaagtgaacacagagagaagagacgcaaaagagaagacaggtggggaaagcaggagaggagggacagagatgtgcacatcctggggtgccaggtgtggcacagctgcagtgccagggtcgccctctcga

SEQ ID NO: 5154 - DNA, 746 bp, Homo sapiens
  misc_feature (3)..(3): n equals a,t,g, or c
  misc_feature (5)..(6): n equals a,t,g, or c
  misc_feature (16)..(16): n equals a,t,g, or c
  misc_feature (28)..(28): n equals a,t,g, or c
  misc_feature (668)..(668): n equals a,t,g, or c
  misc_feature (696)..(697): n equals a,t,g, or c
  misc_feature (706)..(706): n equals a,t,g, or c
  misc_feature (742)..(742): n equals a,t,g, or c
tcnanngggaaatgcnccctcactaaanggaacaaaagctggagctccaccgcggtggcggccgctctagaactagtggatcccccgggctgcaggtttccaaacagaagctgtattccaaattctttcctaatgtggcatacaaagcctttaggatctggctcctgtgtgcctctcctgccgctgctgctgctgctgctgctcctgtttccgcttctgccatggccaccgccactgccgccgcctcctccttcttccctgcaccccttcgcgcctgccttccccgcgaccggcagcctgagctctaacaattctcaactactagcacctcttagactccaaaatgctttgcacctatttaaatgttttcccgtgctcttccctctacataaaatcatttctttccatcctgagtacccatggcaagctcctatcttccaatatttttacttaagcatcccctcttcttctctgcacccggagcatcttggacatagctttgtttccaccttgcattcacccactagacagtaagctttttcaagacagatactgtctcttcttcatctctatatctgtagaacagggtttctcagcgtaagtactgaaggtattttggactggacaattctttgtgtgcaagctggtttatgcatcatataggatgnttaagcagaacccctggcctctacccgnnagatagcancacgcccccttcctcaaatgcctccaaatattgccnaatg

SEQ ID NO: 5155 - DNA, 846 bp, Homo sapiens
  misc_feature (724)..(724): n equals a,t,g, or c
tatccggtagtgattcacttgaatgtatcctcaaatgtagrattatgattacatttcaataaaacttttttaaaaaagtattggttwactattagtattattagtggcattattatgaggtggttyccatttgtttycctcagtggccaccagtgcaactgattttgtcatatactgtactcattgatgcccaaatatatatatcttattttatgctgacttcaaacctgggaagttgatttgtttatctcttcttaactttttggaaatgcagacacaaaaagattcagcaaattgcttaaaatcgaggtaactagcaagcatatatcaagggatacatgactcggcttctgtctagtttcaaagcctgtactcattccatctgaccatgttgcttccataagccacatgccagccacataatgaatttcttgattagaatacaatgcatatacctaccaaagatagtatgtgcatatagcaaatatgagcaatttctaaataatgggagcattatttttgttcaaaatgctaaaaactggggccaggcgtggtggcacacgcctgtaatcccagcactttgggaggccaaggtgggcrratcacctgaggtcaggagtttgagaccggcctggccagcatggtgaagccctgtctctactaaaaattcaaaagttagctgggcgtggtggcacacgcctgtaatcttagctactctggaggntgaggcaggaaaatcacttgaacccggaaggcagagattgcagagccaagattgcaccagtgcattccagcctgggtgacagagcaagactccatctcaaaaaaaaaaaaaaaaaactcgag

SEQ ID NO: 5156 - DNA, 1202 bp, Homo sapiens
gcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaattttwattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaaatttgagctaaattaggaattaaaatwaagttaaaaatttagctccttagtctacgagccacattttaaawgctcaagaaccattawtggctaa

SEQ ID NO: 5157 - DNA, 132 bp, Homo sapiens
gactagttaaccttagtgctttcagaactagctaagctcaatgctttgggaccttcacagtacctccttctgaacttctgtgctgtgacagcyttcttcacccccatactccagtgatcctacacacacaca

SEQ ID NO: 5158 - DNA, 487 bp, Homo sapiens
  misc_feature (469)..(469): n equals a,t,g, or c
  misc_feature (474)..(474): n equals a,t,g, or c
caagacacacasacacacacacacacacacacacacacacacacacacacagaaagagagagagagagagagagagagagagaggaaggacggggactactgcacctatacaaagacaaaggcagcacagatggtcactattctatgactttaccataatgacatttaaaaacaatcattgatgatattcataatcagtcctaactttgggaaatgattttatagtttaaaaagaactttcaaactcagacattgcacatagaatgtgttgggataaccaaaacataagcagaaagggcaaatgttttctagccattatgcagctgctcttggtcacgtaagatgaatttctgctaatccataaaagcagcatgattctcagatgtcccttcattcgtcattcccarcaccaatatcccaccctacttgaggattctaaagcttggtatgtggtcatggccttaacttnaatgngatgggattttct

SEQ ID NO: 5159 - DNA, 803 bp, Homo sapiens
  misc_feature (28)..(28): n equals a,t,g, or c
  misc_feature (31)..(31): n equals a,t,g, or c
  misc_feature (33)..(33): n equals a,t,g, or c
  misc_feature (725)..(725): n equals a,t,g, or c
  misc_feature (763)..(763): n equals a,t,g, or c
  misc_feature (774)..(774): n equals a,t,g, or c
  misc_feature (798)..(798): n equals a,t,g, or c
ctttgcacatagaatgtgttggataccnaancntaagcagaaaggcaaatgttttctagccattatgcagctgtctttggtcacgtaagatgattttctgctaatccataaaagcagcatgattctcagatgtcccttcattcgtcattcccagcaccaatatcccaccctacttgaggattctaaagcttggtatgtcatcatcaccttggtctttgatggctaaatttatgaaggcggctgtgagatttcacttcggaactcagatgaagccagataaatgtgccaaagatgacactggacatatggtacttaacgattctgacggcactcagaataagcaagtctgctgatctcacatctgtggtgatgtagctgacataccattcagcacaaaataaccactccctcacgcatcccaggttcacaattttgcacgcggttaaaggagagttagagttctttgagaactgcattactcccagcaggtcacagaccaactcaaggtgataccatccccaaacagcaattcccagtgccctacacggagctgtcattctaggtctgtgctattcaacaggattatctgcaataatggaatagttcttctgcactgtccaatattgtagccactagccataaatggttcttgagcatttgaaatgtggctcgtatgactaaggagctaaatttttaacttaatttaattctaattagctcaaatntaaagaagccacatgtggctggtaactatcatatagcncagtccagtgntacatcatccaaagtcattcccgnagaat

SEQ ID NO: 5160 - DNA, 1235 bp, Homo sapiens
agacttttacactttaattgccacagcggatttctaacmcaaagcccctaytgcagacaagctcgccatcgtcytcttcaccaaggarttgmrccggcggctgcaaggctctggtgtgactgtcaacgccctgcaccccgcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaargccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtaaaaaaaaaaaaaaaaaaaaaaaaaaaaaaaaaa

SEQ ID NO: 5161 - DNA, 1699 bp, Homo sapiens
  misc_feature (1692)..(1693): n equals a,t,g, or c
  misc_feature (1696)..(1696): n equals a,t,g, or c
gaacggggsatcaccagcgacacctgckawttggactacytctgaascattctttcccttyctagggctttgctggatcccgccsgccccgagatccaacagaacaaascagaraggagacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgaaaaaaaaaaaaaaaaaaaaaccccgggggggggcccggtaacccatttggccnnaanggg

SEQ ID NO: 5162 - DNA, 1323 bp, Homo sapiens
  misc_feature (1133)..(1133): n equals a,t,g, or c
  misc_feature (1183)..(1183): n equals a,t,g, or c
  misc_feature (1202)..(1202): n equals a,t,g, or c
  misc_feature (1282)..(1282): n equals a,t,g, or c
  misc_feature (1302)..(1302): n equals a,t,g, or c
  misc_feature (1321)..(1321): n equals a,t,g, or c
gtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgargctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaactagcagttctgaagatgggtcaatgggggarcttttcggagaagtctaagttcaaaggactcttctggcttgcttcaatcanacctacaccatttaacctaatacctcgtggaagacaggtcggcgggctgnttggacaccacgataaccnttaagcctggaacagaaccgggacttcggcctgaaccggctggattttccagggggttcttgaaaaaaggatgacttcangggcttaccgggcttttggnccaaaccagaaggatcatngg

SEQ ID NO: 5163 - DNA, 2737 bp, Homo sapiens
  misc_feature (2730)..(2731): n equals a,t,g, or c
  misc_feature (2734)..(2734): n equals a,t,g, or c
ggctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgaaaaaaaaaaaaaaaaaaaaaccccgggggggggcccggtaacccatttggccnnaanggg

SEQ ID NO: 5164 - DNA, 341 bp, Homo sapiens
ggctcaagtaatcctcctgcctcagcctcccgagtagcttggattacagggatgcatcaccatgcccatctctcctgctatgacttcttgatgctacttttcctgcttctccacccactgcttcccccaccacccactgccagtcttcctccatctccccttatctgcctgttcttacacactgttccctggaatctctccttggcctcttctcactccacacattctctcagggccttgccttttacttcagccatcgtctatactttcactctagaccactcctctgagatttcccaacttttacatccagatggctgctcagcacctccacctggatg

SEQ ID NO: 5165 - DNA, 1968 bp, Homo sapiens
  misc_feature (1)..(1): n equals a,t,g, or c
  misc_feature (5)..(5): n equals a,t,g, or c
  misc_feature (16)..(16): n equals a,t,g, or c
  misc_feature (80)..(80): n equals a,t,g, or c
  misc_feature (720)..(720): n equals a,t,g, or c
nggcncaaaatttagntcatgatccctccaaacctgctctaatgactcttccatccacacagttgcttaagccagaaatnagttcttcccttttctcacctggtatatcaatcaaccagggattaagtaagtcctcattaactctatttgtctgttcctttccatcaccattatcaccattctgacttaggcctgagctgtcctgagttattgctcccctgcattattttgattaccttctcatagaggtctgaccctctgatctgtactctccaccagggtttctcaaattggcactactgacattttggaccagataatgctttattatgggagctgctaagtgccttgcaggatggttagcagcattctcagcctctacccactagatgccaatagtctcccacccattgtgacaatcagaaatttctctagatattgctaatatcccttctggggggcaaagtcacccctggttatgaaccactgctctacattgactaccatttgcataaacaaatctgataatattgctatagaaaaaagctcaaaccctctgacttggctgagcctccctgcagtctcatctyccaccttcccatctccagtcttaactccagagatcctgagcccctagwaggcccttgaacaaactgggcccttccacacctytgtgcacctyaacctctgcttggaagccttcccccatctgawactctnataaaattgctcattctttaagkctcaactcagggatcccttccttcaggaaagcactcatactgcctatctgkacctcatatatatccccaaatggaaatgktcttattggaatgaaactatttctttgcacatgaatctcccctctataaactccttaagatgaggggagtgacgcattcatgactgtattccgtgtctctaatacagtgactagcacatggtagacattcaatacatgtatattgaataaatcaaacattaagacttcttgtgacagttgtaaaccccaaatggtcatttttaccccgattctctatggttactaatagtaaaaactccaggaaaccacctggagagttgccctcttgcttcaggcactagtgaggagagaagtctggaagccatagcccattggtcctggacaagaaggagagtaaacacgtggaagagtgggtggtggagctgcacagcagcaggcgagcaaatatgcagagtctggccagaggacaagaggtcagccaggcccagagctagcctggaagtctatgccctgaggagatgttcaagagtctggtggagtttggagacataaggacactaagcaccagcctcctaagaggactccctgcccactgtcctctctcctgctgccattctccacagtgcagccaaagcaatctttcttaaagacatatcagattkgcttagagtccttcacttgctccctatgattttcaagataaagttgaatttgtgacctggctcctgtctactgtcttttctcatctcccccgactctttctcattagtacagctgatgccagcctgaacaatacagtctcctgaacacgtcctggtatttgttcagcagctctttccttaggcctggagtctccatctgcacacctcatattatccatttggcaaagtttcattagttcttcaaggcccctcctctgggcttccacagcactcatacgccacctgctgcagcactagttgctgatgtgtctccctatctagactgtgaccaccctgggaacaggattgtctcttttctttgttctctgggcctagcacagtgctaggcttacagtagttaaataaaatcttgaacatatgaatcaaggaacgatctgtcacacacctgctgatccaatcacccttaaagccagatagctaacttaataaaacccaacctgatcattcacttcccagctcaaagaaattcagtgatctcctcga

SEQ ID NO: 5166 - DNA, 387 bp, Homo sapiens
  misc_feature (25)..(25): n equals a,t,g, or c
  misc_feature (28)..(28): n equals a,t,g, or c
aaatatataaattatcaaactaaancanttatgatgaaaaattaatatttatacaaatactacagacaaaagctactgacaaatactctgaacaagtaagtcaggttgggccgggcgcggtgctcacgcctgtaatccctgcactttgggaggccgaggcgggtggatcatgaggtaaagagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtccgcagtccgggctgggcgacagagcgagac

SEQ ID NO: 5167 - DNA, 606 bp, Homo sapiens
  misc_feature (26)..(26): n equals a,t,g, or c
  misc_feature (58)..(58): n equals a,t,g, or c
  misc_feature (80)..(80): n equals a,t,g, or c
  misc_feature (93)..(93): n equals a,t,g, or c
tgccttgagtacccaaagagtccacnacataagcccaggaggcctgaagtccatcctntcaggcagaatcaatcactggnacagagaagggangaggcagtgcataagacaggcagcctcaaagatgggccccactgatcctcatctcctggtgagccttatgtagccccctcataccttgtaccaagattgatctgtgttgtggccaatagagtacagcgaaggttaaattgtgccttctgaagctagatcataaaagacaccacactcttgggtcattcatgctggagaagccagctgccatgttgagaggacactcaagcagtcctacggggcagcccacatgagaggaactgaagcccccagccaccagccatgtgagccaccttggaaatggagccttcagcaccagtcaagctttcagatgattgcagccccaaacactatcttgacttcaatcwcaagaacgtctgccagctagaaccatccagctaaactgctcccagattactgacccacacaatataatgtaaagtaaaaaatgtttgctgttgttttaagctactaagcattggggttatttgttacacagcaatggataacaga

SEQ ID NO: 5168 - DNA, 260 bp, Homo sapiens
cactgtattattttggacagtcaaagacaagcggccaggcacagtgactcatgcctgtgatcccagcaatctgggagactgaggcgggaggattgcttgaggccaggagtttgagacagcctgggcaacatagtgagaccccatctctacaagaaacatttaaaaataaaaatagttcataaaaaatatggaagagggaaggaaagaaagaaattttaaaatttaagaatagtaataaaaaaaaaaaaaaaaactccgac

SEQ ID NO: 5169 - DNA, 547 bp, Homo sapiens
  misc_feature (462)..(462): n equals a,t,g, or c
  misc_feature (506)..(506): n equals a,t,g, or c
  misc_feature (533)..(533): n equals a,t,g, or c
  misc_feature (536)..(536): n equals a,t,g, or c
  misc_feature (545)..(545): n equals a,t,g, or c
gctttgctggtagtccccgcctaactgtcagagagcttcagtagatgggccccagaggatgtgcacttgcccacagcctcctcccactgctttgccagcatgtgtggacctcaccacgctattgccgccagtgcacacgtgaacctcgccactgctgccctgcccctgccagtgcaggtgtacagtacatgtgtgcatatggatgccaccaccccacatttgctggtgtgtacacaccctcccacaccactgttgccaccagcatatgcacacagacaccaccacatcaatgctgctggagtgagcacacgcatgtggtctctaccaccccactactgccggcatacatgcacatgagcatggaccctgctgccaccacccaaatgaagtgcttttgccggcaccccatcagagcatttttaccagtggagtgggaacacctcagccccttcaacacagcangtgcttaacctcgagggggggcccggtacccaattcgcctatantgagtcgtattacaattcactggccgncgntttacaacntt

SEQ ID NO: 5170 - DNA, 571 bp, Homo sapiens
  misc_feature (472)..(472): n equals a,t,g, or c
  misc_feature (508)..(508): n equals a,t,g, or c
  misc_feature (532)..(532): n equals a,t,g, or c
  misc_feature (537)..(537): n equals a,t,g, or c
gtccccatgctattctcatgatagtgaacatatctcatgagatctggtggttttataaaggtaaagttcccctgcatatgctgacttgcctgctgccatgtaagacgtgccttgcacctccttcaccttcctctgtgactgtgaggcctccccagccatgtgaaactgtgagtccattaaaactcttcttctttataaattacccagtcttgcatatgtctttattaacagtgagaaaatggactaatacattaggtcatgagggtggagctctcattaatgggattagtgccttatgaaagagaccccagatagctctcaagctctctttctgctatgtgaagatgcaacaagaagttagccatctgcaacctggaaaaaggccttcaccagaacctggactgtgctggcgccatgacctccagaacaatgagaagtawatgtcyattatttataagcccacccagtctgnggtactttggtgcagcaagttcaaactaaagacagnaacaaatattaattaaaaaaatanttcangcaaaaagccctcaatgggattctaagaattaaa

SEQ ID NO: 5171 - DNA, 821 bp, Homo sapiens
  misc_feature (1)..(1): n equals a,t,g, or c
  misc_feature (34)..(34): n equals a,t,g, or c
  misc_feature (46)..(46): n equals a,t,g, or c
  misc_feature (73)..(73): n equals a,t,g, or c
  misc_feature (104)..(104): n equals a,t,g, or c
  misc_feature (107)..(107): n equals a,t,g, or c
natctctactaaaaatacaaaaattagctggccntggtggcatgtncctgtaatctcagctactttactttgnagctgaggcaggagacccgcttggaccccgnagntggagattgtagtgagccaagatcatgccactgcacttcagcctgggcaacagagtgagactctgtcttaaaaaaaaaattaaattaaactaatgggtacagattggataaggaatgggacttgatatagtttgagatcctccccacagaamacaatgggamaagagtaactttacagtggatagaccttgtagatgccaccttaatcaagcaatcgaagttacatcatcagtaatggggcaaattgaaatcatgcaccacccgataagatgcagtgagaagaacatggcatcacttctgtgatattcctacctcaagttcataacttgaatctaatcattaggaaacatcagacaaacccaaaccaagagacactctacaaaatcatgacctgtgatcctcaaaatttacaaggtcatgaacagcaaggaaagactgaagataaatgcactgtatgatactggattgggtctttttgtgacaaaggatatttgggacaaatggcacaacataaataaattgtagtaaagtgtttatatttttatggttgcattgtggttgtttaggtgaacattattgtaggatttacacataagaatattcatgggtgatggaatatcctgtcggcaatttaccatcaaatgcttcaggaaacaaaactgttcgcactattcttggaacctttctataaacttgaaattatttccaaaaaaa

SEQ ID NO: 5172 - DNA, 4603 bp, Homo sapiens
cccccgggctgcaggaattcggcacgaggggcgcggcggcagtcggctctatgttcgcggtcttaacctctcctctggccgagtccttgcaagaagtgaattacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggacccctagaatagccaagaattatccacaagggagacacaaccctccagatgacattggctccagcttttatcctgaattggcaagttacagttctcgggatccttctgtcatagaaactcacatgagacaaatgcgctcagcttcaattggtgtactagccctctcttggtacccacctgatgtaaatgatgaaaatggagaacctactgataacttggtacccactattttggataaagctcataaatataacctaaaggttacttttcacatagaaccatatagcaatcgagatgatcaaaacatgtacaaaaatgtcaagtatattatagacaaatatggaaatcatccggccttttacaggtacaagacgaagactggcaatgctcttcctatgttttatgtctatgattcctatattaccaagcctgaaaaatgggccaatctgttaaccacctcagggtctcggagtattcgcaattctccttatgatggactgtttattgcccttctggtagaagaaaaacataagtatgatattcttcaaagtggttttgatggaatttacacatattttgccacaaatggctttacttatggctcatcacatcagaattgggctagcctaaaattattttgtgataaatacaacttaatatttatcccaagtgtgggcccaggatacatagataccagcatccgtccatggaacacgcaaaacactcggaaccgaatcaatgggaagtattatgaaattggtctgagtgccgcacttcaagacacgcccccagcttaatttctatcacctcttttaatgagtgggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattcttatttgatggcaattgaattttcattttacaatagataaatgcttgtgttacctaaagcacttagcacacagttaaattatatttacatcctagacccaaataaataggattgtgtgtatatttgggatatctattgaagaaaaaaagaaaaccccttaaaaataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggaaggcctgctatctacagcacagtgtgtcatttgcagatttgtggttacctataccacgctaggtgttttgacatgtttagtgtttctgctttacagtgctgaattccatattttagaagctatgaaagtccttttatgaaaaagttactgattgcttctcagttattaggaaaacagttgtttcacaattattatgtagatatgatgcccaaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatattgtgacaaattgatcacttgtgtacgaaaaataaatctccttaaaaactaaataaaatgcactgtattcttacagttaatgtttataactatagtaaaaaattaatatatatcctattacataaatgttatttcttaggtgttccattaagaagagcaatagaataatgctaaaaaataatgcctataaatcttcagagtataaagacatccattcagaaacaaaaattagcactaaattttttataaaatagaccagatgacaaaatttattttatttttaaacagtggttttgacacaaattatgttattgaaaagcattattaatgtttaatttatttaaaattttggaatttgccatttctcagacaatgatcaggccttaggaaattaatacagtagtagtaatcattttctaggggaaaataaaagaataaatcactatactgatattttgatataagcaagcacttacatggtaatcactatatagatccaacctgtggattttcttcttatgtccatttaactagaatatattattttaggtataatttacaaatgtcacacctaataatcttttataatataccatatttcattaaagttttgttagagaagtatctaccacagaggagtttttgtcattgtgtacgttgtgtatttgaacccaccatgacagaaagtaaattttaggaaatagttatgagattaagggaaaatctataaaaacaaggttagcatattctcaacacagataccaccactttctttttcccattatagacatggtgaatccacacagcatacttcatctctgagctttgttgtgattcctcaacacattaccctaaccagccagcagtaacagatttcagagtaagataaagcagattctgtcttcattgcaaaaagttattctcaatggaagaatggcatctgatctcataattactagtttatattaatatagtttttttctccctttttaataaaataattacagtcatccctcagtgtctgtgggggattggttccagttacccctatagataccaaaatctgcagatgctcaagtccctgatataaactggcatagtagttgcatataatctatgcacatcctcctgtatacattaagtcatctctagattatttataacacttaatacaatgtaaatgctatgtagttgttataccatactggttagtgaataattacatgaaaaaaaagagtctgtacatcttcagagtttcagtcggcaatttcttggccatggatgtagaacctacagataaggtgagccaactgcattaggaaataactctaataattctgttaattcttagagaggaaaactttcaaaatcttcctcaggtatttattacaactgcctttaccattttagttgtaacacagtttaaattgttatgataacaagtaaataagagcaaagaatttatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagggcacgagggggggcccgtacccaatt

SEQ ID NO: 5173 - DNA, 1187 bp, Homo sapiens
  misc_feature (8)..(8): n equals a,t,g, or c
  misc_feature (13)..(13): n equals a,t,g, or c
  misc_feature (33)..(33): n equals a,t,g, or c
ccttcccncctcnttaatgggaaacaaccagcnggagctccaccgcggtggcggccgctctagaactagtggatcccccgggctgcaggaattcggcacgaggggcgcggcggcagtcrgctctatgttcgcggtcttaacctctcctctggccgagtcyttgcaagaagtgawttacccgaccctgcaaaacacttactattttkgagtttaaagtatgtcatcatggcaaagtttcggagaaggacttgcatcattttggcacttttwattctattwattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgktagagcattgggaccctagaatagccaagaattatccacaagggagacacaaccctycagatgacattggctycagcttttatcctgaattgggaagttacagttctcgggatccttctgtcatagaaactcacatgagacaaatgcgctcagcttcaattggtaattattgtatatatatatatatgtgtgtgtttgtgtctgtatatatgcatataaatgattttttgtgtaactttaatagttaattttctcattattattaattatattgttaagctcatacctccaaattaaactgtatgtatgatcttaaacatccaggcaaccacattttaacactgcccttagtgtatattgtttaatttttacattttggagcatttctggatatattgttgatttctaatttaattccctttctcaattttattaaattatgatttacataaaatacaatgaatttccccctttaagtttacagctcattgatgttactcaaaagtatatacctgtttgaatacccccccaatcaaaaagctcaaatatttctatagcccaaaaaaaaaaaaaaaaaaaa

SEQ ID NO: 5174 - DNA, 1476 bp, Homo sapiens
  misc_feature (254)..(254): n equals a,t,g, or c
taaaattttggaatttgccatttctcagacaatgatcaggccttaggaaattaatacagtagtagtaatcattttctaggggaaaataaaagaataaatcactatactgatattttgatataagcaagcacttacatggtaatcactatatagatccaacctgtggattttcttcttatgtccatttaactagaatatattattttaggtataatttacaaatgtcacacctaataatcttttataatataccntatttcattaaagttttgttagagaagtatctaccacagaggagtttttgtcattgtgtacgttgtgtatttgaacccaccatgacagaaagtaaattttaggaaatagttatgagattaagggaaaatctataaaaacaaggttagcatattctcaacacagataccaccactttctttttcccattatagacatggtgaatccacacagcatacttcatctctgagctttgttgtgattcctcaacacattaccctaaccagccagcagtaacagatttcagagtaagataaagcagattctgtcttcattgcaaaaagttattctcaatggaagaatggcatctgatctcataattactagtttatattaatatagtttttttctccctttttaataaaataattacagtcatccctcagtgtctgtgggggattggttccagttacccctatagataccaaaatctgcagatgctcaagtccctgatataaactggcatagtagttgcatataatctatgcacatcctcctgtatacattaagtcatctctagattatttataacacttaatacaatgtaaatgctatgtagttgttataccatactggttagtgaataattacatgaaaaaaaagagtctgtacatcttcagagtttcagtcggcaatttcttggccatggatgtagaacctacagataaggtgagccaactgcattaggaaataactctaataattctgttaattcttagagaggaaaactttcaaaatcttcctcaggtatttattacaactgcctttaccattttagttgtaacacagtttaaattgttatgataacaagtaaataagagcaaagaatttatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagatgaaatacawtgtaaaaaaaaaaaaagcctccctccgtgccgtcgat

SEQ ID NO: 5175 - DNA, 772 bp, Homo sapiens
tcggtttctctctttgcaggagcaccggcagcaccagtgtgtgaggggagcaggcagcggtcctagccagttccttgatcctgccagaccacccagcccctggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggytagcacagatcctaaggaatcaacatctcccgagaaacgtgacatgcatgacttctttgtgggayttatgggcaagaggagcgtccagccagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaaataaaggattt

SEQ ID NO: 5176 - DNA, 488 bp, Homo sapiens
  misc_feature (324)..(324): n equals a,t,g, or c
  misc_feature (438)..(438): n equals a,t,g, or c
  misc_feature (484)..(484): n equals a,t,g, or c
accgcaggggctcccggaccctgactctgcagccgaaccggcacggtttcgtggggacccaggcttgcaaagtgacggtcattttctctttctttctccctcttgagtccttctgagatgatggctctgggcgcacgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaaggctctgcagtcagcgccgcgccgggaatcctgtacccngggcgggaataagtaccagaccattgacaactaccagccgtacccsttgcgcaaaagaacraaagaaatttgccgcactgaaataaatttacttgcgcctaattccccaccccncccggaaaggggaaacccccggggcgtttttccaaattcttttttnttcc

SEQ ID NO: 5177 - DNA, 1112 bp, Homo sapiens
ggcacgagcagacctcggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccactctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaagtgctgcaaggtgtgtccaggtaaaaaaaaaaaaaaaaaaaa

SEQ ID NO: 5178 - DNA, 1273 bp, Homo sapiens
tggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagaggaaaaaaaaaaggtgggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacattagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcaaaaaaaaaaaaaaaaa

SEQ ID NO: 5179 - DNA, 1309 bp, Homo sapiens
  misc_feature (85)..(85): n equals a,t,g, or c
ggcacagactttaagaaatgccaaatgcaaggaccattaagaaaattctccccgaaatgaggctcctctaacaaatgatgattanaacgctctctccttgagcagtcacattctagaaacacgacattccatgaggcaggaagagttcagttaatttgctcckgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggtgggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcaaaaaaaaaaaaaaaaawaaaaggggggcccgtacccatttgccctaaagggatcgta

SEQ ID NO: 5180 - DNA, 1328 bp, Homo sapiens
ggcacgaggcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaataattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctcatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaaaaaaaaaaaaaaaaaaaaaaaaaaaaaaaaaaaaaaaaaaaaaaaaaaaa

SEQ ID NO: 5181 - DNA, 1355 bp, Homo sapiens; identical to SEQ ID NO: 4846

SEQ ID NO: 5182 - DNA, 543 bp, Homo sapiens
gaattcggcacgaggacagatgtaaatgggcagacacctctcatgttatcagctcacaaagtaattgggccagaaccaactggatttcttttaaagtttaatccttctctcaatgtggttgataaaatacaccaaaacactccacttcactgggcagttgcagcaggaaatgttaatgcagttgataagcttttggaagctggttctagcctggatatccagaatgttaagggagaaacacctcttgatatggctctacaaaacaaaaatcagctcattattcatatgctaaaaacagaagccaaaatgagagccaaccaaaagttcagactttggaggtggctgcagaaatgcgagctcttcctgctgctgatgctttctgtgattaccatgtgggctattggatacatattggacttcaattcagattcttggcttttaaaaggatktcttctaktaacactgtttyttctgacatctttgtttccaaggttcttggttgggtataaraaccttgtatacttaccaacagctttctgctaa

SEQ ID NO: 5183 - DNA, 1829 bp, Homo sapiens
  misc_feature (649)..(649): n equals a,t,g, or c
ggcacgaggacagatgtaaatgggcagacacctctcatgttatcagctcacaaagtaattgggccagaaccaactggatttcttttaaagtttaatccttctctcaatgtggttgataaaatacaccaaaacactccacttcactgggcagttgcagcaggaaatgttaatgcagttgataagcttttggaagctggttctagcctggatatccagaatgttaagggagaaacacctcttgatatggctctacaaaacaaaaatcagctcattattcatatgctaaaaacagaagccaaaatgagagccaaccaaaagttcagactttggaggtggctgcagaaatgcgagctcttcctgctgctgatgctttctgtgattaccatgtgggctattggatacatattggacttcaattcagattcttggcttttaaaaggatgtcttctattaacactgttttttctgacatctttgtttccaaggttcttggttgggtataaaaaccttgtatacttaccaacagcctttctgctaagttctgttttttggatatctatgacttggttcatcttattttttcctgatttagcaggagcccctttctatttcagtttcattttcagcatagtagcctttctatactttntctataatacttgggcaactgatccaggcttcactaaggcttctgaagaagaaaagaaagtgaatatcatcacccttgcagaaactggctctctggacttcagaacattttgtacatcatgtcttataatgaagccattaaggtcactccactgccatgtatgcaactgctgtgtgggctcgatatgatcaacactgcctgtggactggacggtgcataggttttggcaaccatcactattacatattcttcttgtttttcctttccatggtatgtggctggattatatatggatctttcatctatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgaaaaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgtagttgaaaaaaaaaaaaaaaaaaaaaa

SEQ ID NO: 5184 - DNA, 1127 bp, Homo sapiens
agaaactggctctctggacttcagaacattttgtacatcatgtcttataaggaagccattaaggtcactccactgccatgtatgcaactgctgtgtggctcgatatgatcaacactgcctgtggactggacggtgcataggttttggcaaccatcactattacatattcttcttgtttttcctttccatggtatgtggctggattatatatggatctttcatctatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgtagttgaaaaaaaaaaaaaaaaaaaaaaaaaaaaaaaaaaaaaaaaaaaactcga

SEQ ID NO: 5185 - DNA, 538 bp, Homo sapiens
ggtttcactctctaaatgaacaaagtgggagatcactgtcatggccaaagttacatggccaagacaaactatggcctgggagtcccaggttctcctgtgtgggcactttcctggcatatgctaaatgatgggaaagtctgggtctcatgtttctgtgtggtcctcacctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagyttctcasatygttgttggggatgamggactgtagttgatgggttagcggaatttcaaactgatcamctggggatgagagcaatgggtaactkaagcttttkgggytcgggggacaggtcagtgcccacgttgttgtat

SEQ ID NO: 5186 - DNA, 930 bp, Homo sapiens
  misc_feature (919)..(919): n equals a,t,g, or c
gcagagctggacagcgcctgctgcccgcctcccgatggccctgccccagatgtgtgacgggagccacttggcctccaccctccgctattgcatgacagtcagcggcacagtggttctggtggccgggacgctctgcttcgcttggtggagcgaaggggatgcaaccgcccagcctggccagctggccccamccacggagtatccggtgcctgagggccccagccccctgctcargtccgtcagcttcgtctgctgcggtgcaggtggcctgctgctgctcattggcctgctgtggtccgtcaaggccagcatcccagggccaccttcgatgggacccctatcacctctccagagacctgtactacctcactgtggagtcctcagagaaggagagctgcaggacccccaaagtggttgacatccccacttacgaggaagccgtgagcttcccagtggccgaggggcccccaacaccacctgcataccctacggaggaagccctggagccaagtggatcgagggatgccctgctcagcacccagcccgcctggcctccacccagctatgagagcatcagccttgctcttgatgccgtttctgcggagacgacaccgagtgccacacgctcctgctcaggcctggttcagactgcacggggaggaagttaaaggctcctagcaggtcctgaatccagagacaaaaatgccgtgccttctccagagtcttatgcagtgcctgggacacagtaggcactcagcaaacgttcgttgttgaaggctgttctatttatctattgctgtataacaaaccaccccagaatttagtggcttaaaataaatcccattttattatgtcaaaaaaaaaaaaaaaaaacttcgtagggggggctccggtacccaatcgccctgatgagtgagtngtattgttccg

SEQ ID NO: 5187 - DNA, 703 bp, Homo sapiens
ggcacgaggtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggagtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacaaaaaaaaaaaaaaaaaaaaaaaaaaaaaaa

SEQ ID NO: 5188 - DNA, 575 bp, Homo sapiens
taagtggaatcccccggggttgcagggaattcggcacgaggcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtrcgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccaaaaaaaaaaaaaaaaaaaaaaactcgagggggggcccgtacccaattcgccctataa

SEQ ID NO: 5189 - DNA, 314 bp, Homo sapiens; identical to SEQ ID NO: 2856

SEQ ID NO: 5190 - DNA, 2161 bp, Homo sapiens
ggcctggcatagaagagtgtcctgaaacctgtgcggagggcctcccagcattcaccctgagctgccttagagttttgtggggctcttctcatcacaggatgctggtcctgggaagagcagtaagttgcaagtcaggagacctgcagtgtagttgtaatggctgtagattacttctgcactccttcctagctctcaaattccttgattctttgatagcataggggctttggtcccacaattccttgctaatgatgatgaactgagttctcacacttatgggctgcttgttaataaaaataatcacttaggccatttagctgtctgtatttcccagtgcatttggggtcttttatctccatgtgagcttgyyggtatctctttgggttccattatcctgttctgtcccactccatgctccatgcagactccaagccccgcttgctggagcccctctgggaaccctggtttggcccatacactatgctggcgtgcatgcaccttgatgccccttctgaggctgggcccttacctcgtcactctttttgccctacccagtgagacagaacaactggccccctctgccctcgtggtgccctgtgaagccctgcttctatcaggatttctccacagagatccctgccgactaccagcggatatgcaagatgctctactatctgtggatgtgtgagtcccactcctgccttccaakcgcaagggcgaattgggtgtgacttgagagccccatcttggtcctggctgctcctccctggtatacaggctttcagcagactccagccttcctcagtgcctgggctgggttggggagatgcctctgcccacaggctgccccctgtctggaaacctccttgaaaggggcagtccagaccaccgatcagggagggtgggactaactagaggcttccaagttccttcagagctcactgcactaaaaggccctccttaggtgaaggccttccctgcccacaggsctgtgaactctgaggggtgaggaaggagactccccctgcagctccatcaggggccatccagggccagggaaaagcattgctaagagaaagacttccttccccaaggaccagccctgggtctgcatcctccctccacacccctcagatacccgggctgtcccatcacctctcaggaacgtagtttgatccctggttttgaggtcccagaaaaccaggatatgggaactatccctgcctaggtacagagcgggctcctctgtttcagcagctgccttcgsagcatgaacctcacctctcctagggagtggctgccacattggagcccctcagccactgtggcacaagtcataactctgcctgccccttcccagtgcattcagtgactytgkttctgaacctgcttgcctgcctggcctggktctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacaggtgagacctgggcatcacagagggaattaggctttggatatgggactcagcctctcttgccctgttttctagctcccacagagccccgccagtgccctgcttttcccatggcggggagtgggtgagtgggccagctcggatctgctttgggccttctctccagttcttcatcagtagccactcactttttttttctccttgatactaaaggcatcaaaagacactcactattggtcaggtgcagtggctcatgcctggaatcccagtactttgggaggccgaggcaggcagattgctcaagcccaggagttcgagacagcctaggaaacacaggaagaccttgtctctaccgaaaattaaaaaaattagcctgttgcagtggcatgcacctatagtcccaggtacttgggaggctgaagtcaggaggatcacttgagcccaggaggttgaggctgcagtgagccatgattgcaccactggacaccagcctgggtgacagagtgagatcctgtatcaaaaaaaaaaaaaaaaaactcgag

SEQ ID NO: 5191 - DNA, 595 bp, Homo sapiens
  misc_feature (81)..(81): n equals a,t,g, or c
  misc_feature (552)..(553): n equals a,t,g, or c
  misc_feature (575)..(575): n equals a,t,g, or c
  misc_feature (577)..(577): n equals a,t,g, or c
  misc_feature (584)..(584): n equals a,t,g, or c
ccaacttggcagtttatttgttggttaaggttgtttttactcaccactatgctaacgaggaacttggcagtttctttaaangttaaaccatatatctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaaaaaanngggggggggcccgtacccattngnctttagngggtcgtttta

SEQ ID NO: 5192 - DNA, 2057 bp, Homo sapiens
ccgagccggctgcgccgggggaatccgtgcgggcgccttccgtcccrgtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgmtgtttatcctgcagctggacattgccttcaagctaaacaaccaaatcagrgaaaatgcagaagtctccatggacgtttccctggcttaccgtgatgacgcgtttgctgagtggactgaaatggcccatgaaagagtaccacggaaactcaaatgcaccttcacatctcccaagactccagagcatggagggccggttactatgaatgtgatgtccttcctttcatggaaattgggtctgtggcccatgaagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacaggcatcttctatgcratgcttctktccttctggatcatcttctgtggcgagcacatgatggatcagcacgagcggaaccacatcgcagggtattggaagcaagtcggacccattgccgttggtccttctgcctcttcatatttgacatgtgtgagagaggggtacaactcacgaatcccttctacagtatctggactacagacattgggaacagagctggccatggctttcatcatcgtggctggaatctgcctctgcctctaacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattgggaaatggggcggcgtcacagtcccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattgtcttacttctcttaaaaaaaaaaaaaaaaactcgtgccgaattcggcacgagcggcacga

SEQ ID NO: 5193 - DNA, 1602 bp, Homo sapiens
  misc_feature (1599)..(1599): n equals a,t,g, or c
  misc_feature (1602)..(1602): n equals a,t,g, or c
ggggagtgttgttaaccggagggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccssaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagtacgagctctggagggscatgagcggcagaactggaggcccggtgcanaan

SEQ ID NO: 5194 - DNA, 1789 bp, Homo sapiens
  misc_feature (1742)..(1743): n equals a,t,g, or c
  misc_feature (1781)..(1781): n equals a,t,g, or c
  misc_feature (1786)..(1786): n equals a,t,g, or c
gccgcagtcgcgcggattgagcgggctcgcggcgctgggttcctggtctccgggccagggcaatgttccgcacggcagtgatgatggcggccagcatctggcccaggctctggytctgccccaraggctggccctgcccctggtttccccttccctcctccctggatgggtatgcccctgcctccaccctttgccttccccccaatgcctgtgccccctgcggstttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaannaaaaaaaaaaaaaggggggggcccttttaagaaccagnttaanaac

SEQ ID NO: 5195 - DNA, 932 bp, Homo sapiens
  misc_feature (675)..(675): n equals a,t,g, or c
  misc_feature (920)..(920): n equals a,t,g, or c
gcttatctgaaattgtaacctgcctcctctctttggaactctcagtccctctgatgttgttctttctgtaatttacttatttattctgtttattgtgattatctattttgccccactctacactagaatcacactccacgaggtcagggattagtgtttatttcgtttattgacagatgccaggcatttagaatagtgcctggcacataataaaggcttattaaatagatgttgaataaatgaatcacctctttatagtgcctgtgccctaaactagatgatatcttgtctttgtaactttatagcacactgtgtagctctagtgatgcgtacatgtatgctggttgtatcttccaactttgctccttctttcctttaatatataaggtctatttaggaattgtcatctagcatttggatcagtgtccagtgatgttacatagtaggatttatcaaattttagaaagagaaaggaatttaccacactatcaaagaagtttaattactatgtcttattttttggtggaatcatatttaatgaaagagaatgtgaaattgctttgtcttatagttcagaaaccagttttcaaaacttccttcatgtagtaaatggaatcttctagtgaatgycatgaaatttccaaattgkttttttttaattttttttaaaattgnggtaagtacatataacatamaatttgccaccttaactctttttaagtgtacacttcattggcattaagtacattctcaccgttgcataagygtsaccaccgaccagttccagaatatttttaccttgcaaacctgaaattctgtacccattaaacagtaactcctcattcctccccaacccttagcaatcaaagttttactttctgtacctatgaatttgatattctaggtacttttatataagngaaatcatacag

SEQ ID NO: 5196 - DNA, 661 bp, Homo sapiens
  misc_feature (7)..(7): n equals a,t,g, or c
  misc_feature (22)..(22): n equals a,t,g, or c
  misc_feature (47)..(47): n equals a,t,g, or c
  misc_feature (660)..(660): n equals a,t,g, or c
cgttttntacttaaaaaccccncccaaaaaaaaaaagtgctataatncatttgcttgtaaaaatatcctcatcacttatccacatatataagccaggcttctaaaaatggcatttctcacctgtagtcccagctactcaggacgctgaggcaggagaagtgcttgaacccaggaggcagaggttgcagcaagctgagatcgcaccactgcactctagcctggtcgatagagcgagactccwtcycaaaaaaatgaataaataaataaaaacagtatttctgggacaaaggtatacagacccaaattttatagcagttgttttcattcatttacctatagatattttaaaagcacctgctaggccgggcacggtggctcacgcctgtaatctcagcactttggtaggccgaggcgggcggatcacgaggtcaagagatcaagaccatcctggccaacgtggtgaaaccctgtctctactaaaaatacaaaaattagctgggcatggtggtgcgcgcctgtagtcccagctactcaggaggctgagaatcgcttgaacctgggaggtagaggttgcagtgagctgagatcacaccactgctctccagcctggcaacagagcgagactctgtcttaaaaaaaaaaaaaaaaaaagggcggccnc

SEQ ID NO: 5197 - DNA, 940 bp, Homo sapiens
  misc_feature (940)..(940): n equals a,t,g, or c
gaawttaataagctcctaacataaatttgatgtcatttgcagatgagaaaatggggcttgatgaagttgattgcttcaatgatgcaaccagtcctgcttgaactcctctctgtctggaggaaggaaggcagagactctagaaacatacatgattcccacagcatgtatgtgctgaggaagagactgagtgggtcttggcttcagcaggtctgtactctactgtgatatcagcagcactcatccttgaatctccaagagcttgtcttccttcaaaaggctgattcagacacagagtctagacttgtttctcttttcttaaaagtacacatcaggaagaaaacctaasgcctcttgtaaaaacatcactgacatgcttcctggtgatttytcagcagctatttgtcccccagatatattttttcactgccatttcacccaatgttaattgaaatgctaaactaaatgtttagccatccttgcatgcatggataattaataaactgattataaaattatagtgatgagggattactaagccatgataaattacaatcattatttcagtcttgactataaagattattataaggatgatagaggkttcttatggatttttagtcatttacacataatgaagtaaaaatgkctttttcaattttcaaatatgtcaccgaagccaaaattggatcttgtcatttttaagttttgtatatgcttgatttctgttgtatttgwttcagattgwgyttgcttcatgaaaaggatgttttcttttttcaggtagtgaggggtttaactacattttatttctcccaaaagcttattaatcttggcaataaaaattctatatttctccagcaaaatctaagatgcttacctcaaagcagcttttgaagttatttctatcagtattggtctgattatgctgtgaggagcctgn

SEQ ID NO: 5198 - DNA, 490 bp, Homo sapiens; identical to SEQ ID NO: 4013
  misc_feature (476)..(476): n equals a,t,g, or c

SEQ ID NO: 5199 - DNA, 1253 bp, Homo sapiens
  misc_feature (1188)..(1188): n equals a,t,g, or c
gacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttgtcttaggcatagaagccccagaggaacacggccactgccatcatgagcagggcattgaggttgaccacacgggcccagctcgggtcctcgctgatgtcctccagccgcctggctgctgcsgctgcytcctcctggktaaggggcgrangastgycaccccacctctgctyattccacamaaccagagcaggmactggcgcgaagaagggcttg

SEQ ID NO: 5200 - DNA, 958 bp, Homo sapiens
ttttttttttttttttttttttttttttttttttttttttatttaaatacatttatttgaaccggcctgggggaggcttgatgttgatgggttggtgattaaagcctcccaaagccaatccttggcatggcctttgggactcaaaacacaggatctgactggtgggcacaataccatcttgaacgcccacaaaaaggtttggttttgttgccaaagggcaggtggctccaggcagggctgatggtggcagggtggggtgaggacaggacaagagatctgggtgtggaaggatggccgggtttctgcagcagcaggaggaaagggtgggagcacacaggcacagaacactgtgagcaggactgccaggccagtgtcacaagcgctaccatctgggtgtagacagacctgagctgacaaagctgggggagcaaggccaacggctttaaacacaagctcaggggcttggggtttatcccgagggcacagggcagccatgtagggtggagttggcatgagttaagcctgggctgggtgtgtagactggacagaggtgggtagggcaggcagtgacgagctggtgtgcaagagactttagggccaggcatggggggacagaactcccacctcgttcgtgctcccaccctccccagctccaccgcctggtcttcagtctccggcatagcaaggaggaacgggaggacctggatgctgatgagcagcaaggctcctcactccctgtacagaatgggtgcccagagagtgccatggagatgaatggtagggcaccatgctgggaggtggggctggaggagctgagttcccgcaaactaactgcagggcctcaatttccctcagagccccaggccccggcaccaagcctcttccgccagtgcctgctctggttttgtggaatgagsaraggtggggtgggcagtcctccgccccttacccaggagga

SEQ ID NO: 5201 - DNA, 1822 bp, Homo sapiens
  misc_feature (466)..(466): n equals a,t,g, or c
  misc_feature (1465)..(1465): n equals a,t,g, or c
tcatttggttgccaaatsstagattagcgctgggtcagctgtggaagaatcgcctcagcttacagattgtcagacagatctaastagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagaanctggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgnttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaaaaaaaaaaaaaaaaaaaaactcgaggggggccccgtacccttttcgaa

SEQ ID NO: 5202 - DNA, 320 bp, Homo sapiens
  misc_feature (313)..(313): n equals a,t,g, or c
gaattcggcacgagctcaacctcaggaagtcagtccctgggagccatgaagtgcagcaatgacaggcccatctggagaagacatgacggctgggtctgcaggacysagmtarctcaggagcagatttggggatggcaatcagatgctgttcttctacctcaaatgccttgatccttattctcttcamctggacagttcttctttcatcatccmagatccagytccttcctgcccttctttaagagggctttcatggaccttttccctggggttattgccatcataggccattccatggaatttttttttaaanggcattt

SEQ ID NO: 5203 - DNA, 708 bp, Homo sapiens
tcgagtttttttttttttttttttaaattagtcaaacattttattatagagtatatatttatatcaaaagcacaaaaacgtttattctgaaaaccaggaagattgtgatgttacagaagaagattcaataattccagtccatttctagggtactaagtgtctgatcacctcagygaaaacaagatacaaatgaggccaaggtcacaggtctggccaccctgagtcccttcgcactatttggtttctcaagttgagacacgtattcccagtcccagttagccaccttccaagtgtttgctactagccttaatgggtacttagccaaagactacacccaaatataaccaaagcttatgttaagtcataagattaatccttcaataataaggatagcataattggctttgttacctaattctacataaacaaaatcatcaaatatcctggcataactgaaatgacttacagaggaagtagtaaagcttggaagtattctatggtaactgagctgaaaaaggggaaatgccaaatgttgtaaatgccatcattaccaataagagtcaccaaattctcagaaataggtaattggcagctcaaggcagttagcactacaagatttctcttgcctttaaaaaaaaatcatttttaagactccttttttaaaaggctacatcaaaaaataaaccaaaataacctcgtgccgaattc

SEQ ID NO: 5204 - DNA, 604 bp, Homo sapiens
ccgttagacgccagttcgaaattaaccctcactaaagggaacaaaagctggagctccaccgcggtggcggccgctctagaactagtggatcccccgggctgcaggaattcggcacgagcagcgcgcacttaccaccatgcagatccaggtcgcggggctgctgcagtttgccgtgcccctcttctccactgcagaggaagacctgcttgcaatccagctcctgctgaactcctcagagtccagccttcaccagctgaccgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccct

SEQ ID NO: 5205 - DNA, 268 bp, Homo sapiens
tttttttttttttttttttttttaaatgaggggacctgttcctgacaaactacttgtttcctaaatgaatcccaaacttgcttgaattcctacctcttgacctttgaaaaatgggaacacgctgctcttgcattactggcagctgcaatgcagcatttacctggactatctctgcatcttgttcttgtgtttctggagtcactgggaagctgtgcaaccccacaccccagagcagcaccagcagcaaaaaaaaaaaaaaaaaaaaaaa

SEQ ID NO: 5206 - DNA, 978 bp, Homo sapiens
gaattcggcacgagatgagtttggccacgtgatgcaccagctctgctcccaggtgggtgcgggcccgggcaggggcaggggcaggggcaggggcaggggctgcctgtggtcagcgaggcccaagcctggggcttcggcttccggctctctctgcacccgtccggtggctccttcatccaatgccacccaaagatggtgactccctgtcatgcccgtgtcctggggctgccccagcaaaacaccacagaccagggcttacacaaggtgcgtgtatttcctcatggtcctagaggctggagtcggaggtcacagtgtcagcagggttggctccctcgargtccctccttggcttgtggccgccaacaacttcccgcatctcatgtggtcgtccttctgtgtgggtccccatytygtcttcttacrggaccccagtctgccggatccgggcccgcccaacaacctcacttgacctagtgacctccttagacatctgtctctaagtagtcacatctgggattacggcgtgagccatgttcccgcggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaaaaaaaaactcga

SEQ ID NO: 5207 - DNA, 748 bp, Homo sapiens
  misc_feature (15)..(15): n equals a,t,g, or c
  misc_feature (17)..(17): n equals a,t,g, or c
  misc_feature (29)..(29): n equals a,t,g, or c
  misc_feature (32)..(32): n equals a,t,g, or c
  misc_feature (646)..(646): n equals a,t,g, or c
  misc_feature (741)..(741): n equals a,t,g, or c
ggtgcggccgtttanantagggatccccnggntgcaggaattcggcacgagcttattgkatgtgctmcagtgacaggcatctgggacttttccaatctgaagctgttaggaacaccaccaccatgaatattcttgtatgtgttttctggctctggggtggagttgctgggtcatggggcaggcacattttcatttttacttcagtaaaaaatgtcyagkgggccagccactgtgcctggcccaratgacttcttcacaaggagacacatactgtgtgtatcagtcaggatccaaccaggagacaaaccacacagtaatttaaacagcgattgtttaatatacagaattgttaactatgataggggatttgagtaagaggaactggttactaagaaataaagagaatgctaacgaatgtagaaatagactgggcacaatggctcacacctgtaatcccagcactttgggaggcaaggcaggtggatcacgaggtcaagagatcgagaccatcctggccaacatggtgaaaccccgtccctactacaaaaagtagctgggcgtggtggcgtgtgcctgtagtcccagctactcaaggaggctgaggcaggagaatagtttgaacccaggaggcagaggttgcggtganccgagatcttgccactgcactccagcctgggtgacagagagagactccatctcaaaaaaaaaaaaaaaaaaaaaactcgagggggggcccggtanccaattc

SEQ ID NO: 5208 - DNA, 1390 bp, Homo sapiens
  misc_feature (665)..(665): n equals a,t,g, or c
  misc_feature (1294)..(1294): n equals a,t,g, or c
  misc_feature (1307)..(1307): n equals a,t,g, or c
ggtttctcctgtccaatggcagtgtcccacatcaggttcataatggcgacatgctaattccacatgggcagagccaatgccaaggcattggtgtagtgttactgggaagagaaagaaaagccatattctcacagtagcagggaagtggtcaaaacagtcaggtgtgtgttgatggatgagcagattttcccagaatttcagaggtaaagaagatcacattgtgtttctattttgttttaatgaaatttttttccttttgttgatgctgttggtgtttccatggttattatcaaaagcagtttctggttttgctgaaaggctagaaatgacaactattttcagagtttctaggtcttgaaacatcagtcaacctttcaaagccagcattgatcaagaaggaaagaggtttttctaatgaggaaaataaaatagtaaatgatactttgacattccattagttgtaggaatgtgtgccccaactgactaccttgctttgctctctctctttccctctcttttctaagttttgctaataataaaacttaggragtacacatttaggaaactgtctgtccttgtgactgrtggcatttatacataaaggkyacckggggtgtatggggggaggttcatgaatgcagtttttcttttcttttttctgtgtntatgatyccgtatcaaattttaacytcyagatgtttatttttttaactgcagtcaaggcacaaaccagtgtaaatcagctgcacaaatgtttgtcataataaatttttattaggttttatattggaagccatttagaaactagtcttataatcactcataaaacattagctatcttattgttttacaagagtatgtagagtatagtaatttcttagtaacatcccaaatccgtctttctccaaacacaataagcaaagctgtgttttctgtgattcagtaagtcagattgcattttgagtattcatgtagttttccccacccccctgaatcaggaattttcttcccccattattattgktttcttaaaaaaaaaaaaaaaaaactcgagggggggcccggtacccaattcgccctatagtgagtcgtattacaattcactggccgtcgytttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgngttaaatttttgntaaatcagctcattttttaaccaataggccgaaatcggcaaaatcccttataaatcaaaagaatagaccgagatagggttgag

SEQ ID NO: 5209 - DNA, 879 bp, Homo sapiens
ggaatctgcaccatgccctgggttctgctcctcctgaccctcctcactcactctgcagtgtcagtggtccaggcagggctgactcagcccccctcggtgtccaaggacttgagacagaccgccacactcacctgcaccgggaacaacaacaatgttggcgaccaaggagcagcttggctgcagcagcaccagggccaccctcccaaactcctgtcctacaggaataataaccggccctcagggatctcagagagattatctgcatccaggtcaggagccacatcctccctgaccattactggactccagcctgaggacgaggctgactattactgcgcagcatatgacagcagcctcgcagtttggatgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacagagcaacaacaagtacgcggccagcagctacctgagcctgacgcctgagcagtggaagtcccacagaagctacagctgccaggtcacgcatgaagggagcaccgtggagaagacggtggcccctacagaatgttcataggttcccaactctaaccccacccacgggagcctggagctgcaggatcccaggggaggggtctctctccccatcccaagtcatccagcccttctccctgcactcatgaaaccccaataaatattctcattgtcaatcagaaaaaaaaaaaaaaaaaaaaaa

SEQ ID NO: 5210 - DNA, 928 bp, Homo sapiens
  misc_feature (49)..(49): n equals a,t,g, or c
  misc_feature (78)..(78): n equals a,t,g, or c
  misc_feature (148)..(148): n equals a,t,g, or c
  misc_feature (163)..(163): n equals a,t,g, or c
  misc_feature (532)..(532): n equals a,t,g, or c
cctctcgctaattaacccaattggccaaaagggggatgttgcctgcaangccaattaaatttgggtaaacccccaggnttttccccaagtccacgacgttgtaaaaaacgacggcccaattgaaattgtwaaaaacsaacycactaanagggccaawtgggtnacsgggcccccccccgartttttttttttttttttttctgrttgwcaatgagratatttattgagggtttattgagtgcagggagaagggctkgatgmcttgggrtgggaggagagacccctcccctgggatcctgcagctcyagkctcccgtgggtgggggtkagrgttgrgaacctatgaacattctgtaggggccactgtcttctccacggtgctcccttcatgcgtgacctggcagctgtagcttctgtgggacttccactgctcrggcgtcaggctcaggtagctgctggccgcgtacttgttgttgctytgtttggagggtktggtggtctccactcccgccttgacggggctgcyatctgcnttccaggccactgtcacrgctcccgggtagaagtcactkatsagacacacyagtgtggccttgttggcttgragctcctcagaggagggcgggaacagagtgacmgwggggkyrgccttgggctgacctaggacggtgaccttggtcccagttccgaagacmccatgattaccactgctgtctgttgagtaacagtagtagtcagccgcatcctccacctgggccccactgatagtcaaggtggccactgtccctgarctggagccaragaatctctsagggatccggagggtcgtttgttgtcctcatagatgaccaggcacaggggcctggcctgacttctgktggtaccaatawacatatttcttcggcaatgcatctccaggagcaggtgat

SEQ ID NO: 5211 - DNA, 885 bp, Homo sapiens
ggcacgagggaatctgcaccatgccctgggttctgctcctcctgaccctcctcactcactctgcagtgtcagtggtccaggcagggctgactcagcccccctcggtgtccaaggacttgagacagaccgccacactcacctgcaccgggaacaacaacaatgttggcgaccaaggagcagcttggctgcagcagcaccagggccaccctcccaaactcctgtcctacaggaataataaccggccctcagggatctcagagagattatctgcatccaggtcaggagccacatcctccctgaccattactggactccagcctgaggacgaggctgactattactgcgcagcatatgacagcagcctcgcagtttggatgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcataggttctcatccctcaccccccaccacgggagactagagctgcaggatcccaggggaggggtctctcctcccaccccaaggcatcaagcccttctccctgcactcaataaaccctcaataaatattctcattgtcaatcagaaaaaaaaaaaaaaaaaa

SEQ ID NO: 5212 - DNA, 408 bp, Homo sapiens
  misc_feature (139)..(139): n equals a,t,g, or c
  misc_feature (355)..(355): n equals a,t,g, or c
  misc_feature (389)..(389): n equals a,t,g, or c
  misc_feature (407)..(407): n equals a,t,g, or c
tttttttttttttttttttctgcattgccagggtaaggaaagacaggcagcctacttccaagcaagtgatctgttataggtgggatagtgaaactgtcacttacaacattcttgtagagaatgaacacaagacaacacncatactggcaaagagagaagctttgaggggaggtgtgtgatatattgagtctacctttatccctctttccctatcgaaccaccttcccctcatggtaaagctgggacctaggtatattggtggcaacatttctctgctgctgacctcaaagagactaaaagcatacgtgattgaaatgaaaaataaatgagcagctatttataaataactcctgtnaacgaaggcatgtgtttcatggaaataatctcanacaaatgactgctttatnt

SEQ ID NO: 5213 - DNA, 1937 bp, Homo sapiens
ggcacgagctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaaccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggtcactcgagacagcaaattcctcaatcatgaaggctacggaattggggatgatgaatactcctgtgcgtatgatggctgccggcagctgatttggtacaatgccagaagtagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaaaaaaaaaaaaaaaaaa

SEQ ID NO: 5214 - DNA, 2133 bp, Homo sapiens
gaattcggcacgagcgcgtaatggcagcgccgtggcctcgcgtccatctttgccgttctctcggacctgtcacaaaggagtcgcgccgccgccgccgccccctccctccggtgggcccgggaggtagagaaaaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaaaaaaaaaaaaaaaaaactcgaggggggcccgwacccaawtcgccctataaacgccgat

SEQ ID NO: 5215 - DNA, 1963 bp, Homo sapiens
cccccgggctgcaggaattcggcacgagctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctgggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaaaaaaaaaaaaaaaaaac

SEQ ID NO: 5216 - DNA, 1937 bp, Homo sapiens; identical to SEQ ID NO: 5213

SEQ ID NO: 5217 - DNA, 770 bp, Homo sapiens
ccacgcgtccgcagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgaggacttgcttactaaaactacaaaacttcaaaaaaaaaaaaaaaaaaaaaaaa

SEQ ID NO: 5218 - DNA, 637 bp, Homo sapiens
  misc_feature (619)..(619): n equals a,t,g, or c
ggcagagccatgcccagctaatttttgcatttttagtagagacggggtttcaccatgttgggcaggctggtcttgaacgcctgacctcaggtgatccactctccttggcctccctaagtgctgggattacaggcatgagccaccgcacccggccatgttatttcttatttatgtgtctttgcttatgcttttattttcgctttgtctgtccctaccacacctacaacccccttccttgagggaaatactgattcctgttcattctttaagattcagcttagtgtcacctcttcatggaagtcttgcatcatctcttctacttcagcactgtggcactttgagacaagttttcttttaatcccccttgktttgtgcgtgtgcatgcagaccaaatcttcgtcagcactagatattgtcatttattaaatttaatcctyckaatgtgtagcgatatctcattgtggtttttagtatttcactgatgcctaatgttgtgcatcttttcatgtgcttatttgctatccgkgtawcttctttgaagtatctgttcaaatattttggyaatttaaaaaataaaatgctttawtattttgktttgagagtccttawatattctganttgttttttttccaatac

SEQ ID NO: 5219 - DNA, 1098 bp, Homo sapiens
  misc_feature (88)..(89): n equals a,t,g, or c
cgcatcacagacaacccagaaggaaaatggttgggcagaacagcaaggggttcatatggctatattaaaacaactgctgtagagattnnctatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcagraaaaagaaraaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcmagaaaattaatgcacaraaccacttattatcatttgttatgaaatcccaattatctttacaaagtgtttaaagtttgaacatagaaaataatctctctgcttaattgttatctcagaagactacattagtgagatgtaagaattattaaatattccatttccgctttggctacaattatgaagaagttgaaggtacttcttttagaccaccagtaaataatcctccttcaaaaaataaaaataaaaaaaaaaaaaaaaaactcgagggggggcccggtacccaat

SEQ ID NO: 5220 - DNA, 3018 bp, Homo sapiens
gccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttgggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctcccttttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaaagccgatatagtagctagctacttaagcatccatgggtattgctccatatcaaagcagatttgcaggacagaaagagtaaattagccttcagtcttggtttacagcttccaaggagagccttggscacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctaactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagatgggaggattgtttgagcctaggagagggaggttgcagtgagccgtgatcgcaccactgcactccagcctgggcaacagagcaagaccctgtcttggagaaaccagaattttggaagagcaaatggggctgagtgcagtggctcatgcctgtaatcc

SEQ ID NO: 5221 - DNA, 770 bp, Homo sapiens
ccaatactcctttactttctttgagttacaatgttgcatctattctgttcacagcccctaggrctccttttcctgctgatctttctaggtcttgactctctgcctcgttgcttgaccgctacccggcttcagagtccaataattatattttcaactttgtcctgtatatgctccacttcttggctggaactctgttcagtttatttcctgactttgaactatctccacgtagtgccaccttgtttcctgatctaaggactgtgcaactcctctccagtcggccacatctctgaccaagggattcagtgaaaactctggtttctcacctgaactttgatctttaaccccagctgacactagtaatggcctttgtgatcaggctctgaaagaagactgacttcatgtgaaccatgtgagcatattgttcatatatccctcaaggtggatccttcttttctaaaaggcatctaaaaagcaacggaagttcttttgaaaatcagaggctgcctttttggtagcagttctttcatttattctgtagaggatccagattgagctctttataaaatattctcctacataatgtactgggatagtcctaacaatagtaaaccttgatccacagatcacatgtgccattggataaaaataaataatgcaragraactcaataagaccagcctgtttaaaggagacatcataaaaacctccattaaaaaaaaaaaaaaaaaactcgagggggggcccgtacccaatcgcctgtgatgatc

SEQ ID NO: 5222 - DNA, 3963 bp, Homo sapiens; identical to SEQ ID NO: 791

SEQ ID NO: 5223 - DNA, 2196 bp, Homo sapiens
cccccccctttttttttttttttttttttttttacgttttatcaactgccaagatcctttattttttccaggccccttcctgcccactccacatcggggcagctccagcataagggagatgacatgatgaaggggctaagagtagggcctggccagcatccactgagggcccaaccagggaacagttgctagccgctctcttccatgcagctggagcactagcaaggccttccagaggctcccagggcgacctccacatcactcccgcttgtctctgccctccagggtgctccgggcctcctctccctgtgtaccctagaggtgtgagggccacagtcctcctcaggtgaacctccctccccaagcccagggccctagcacaggctgcagttggacggcttcgagctgcggctctgggcctagagcaaagagaggggaaggaggggaagacacagtgcaacgtcaaggaaatgagggacagccctcatttcagagctcagcatgggctggagtcatactgaaaaccagacgataaccaccattccaaaactctgcaccactaggaagaacccccatccctgacttcttcctcccttccactgcagcatatatcttcagcccagcctcatacctgctgccgctggtattctgcctcactggctgacagtgcttgtgctaaagctaggtcttcttcctcctgacaactgggagggagaaacagtttaagttggatgatggtaagatctgaaatttgaacatctgatctgtgtgtgttgggcctcatggtgctgagcactgctgaggattatctcaatcttcatagcaacactacaaggtgggtattagtattgtccccgttttatagaggaaatgaaggctccatgggttaaataacttgtcaaagatcatatagttcatcttaattttgagaccaagttgccagcgattatcttgcattgtgtcagagtggtcccacctacctgcctccagaccaagcccttgcccacagcttgcgctctctttcacaagagggtaaggtaccttggaacctggggtttggtttctgccagggacatttccagggcccgctgcagagcttcatcctcactctacaaagggagaaagaagaccagcgtccttggacttcactctctgtgtgtttgtttctgtccatccaacctctgcccaactcaccaggccattctgcaaagcaatcactggaggggctgtccaggacggagatcgggttgtggctctgctgggagaggtacaggaaggcatggtttgacttgggctggggacagtgcttgtagaagccacagcttgtgctctggagatggcagcaagtcctgcccggctggttgggtgcccctccccagagcaatcatggtccagtggatgccggtgcttgatgcagaagtttcggctacagcgttcacaggtcagtttcatcatttctcgctgccggcagccagcgcgttcacacttattggtgaagatctgaggtgaagtgagaaggttgtctctgctgagactctgattagctgtttgggtttccaggcatccgtagtcccagctgggttgtggctgacccctacaatgtttaccttacgtttttgctgtgctggatcagagcgacagtctctgtcaatgtgctctcccacagcacggtcagggggctcccctctggccacaggcacaggcacattacagagagggcacacaggtacctggatatcctgtagtcaaggagcaagggtcagtctgtggcccactccagtccaacaaatctctggtcctgaaagaacttggatatgacccaccacaaacacgcraaaaaacagtgtttcccagcactgacagcytcagaaggacaaaagggagaagaaacgtgagacacagatttgggggattctgcacgcattctccatctgcctgctttcaccctgaggatcgccccctcaccttttggtaagcagatccacagtgatgctgggcgtaggccacatggtctgcgcagaagatgcctgagcaggcatcacacttaagcggcagaaaatccaagcgctgacagctcggctccgaacagtgagcgccgaggtccggaaactccatcgccaagccgggcagggtctgctaggagaagcgacgagtgctgagcgtctttagggctcgtgctcgaagtccgcaccgcgc

SEQ ID NO: 5224 - DNA, 711 bp, Homo sapiens
  misc_feature (602)..(602): n equals a,t,g, or c
  misc_feature (657)..(657): n equals a,t,g, or c
  misc_feature (666)..(666): n equals a,t,g, or c
  misc_feature (686)..(686): n equals a,t,g, or c
  misc_feature (699)..(699): n equals a,t,g, or c
ggcacgagagatagtgtagtgcaaaggatcatggtttggaatttggaagcctgcgactgactcttcaccctgccacttgctacatgtgtaacctaatgactgaacatctgaacccctgtttcctcatctgtgggaataaataaatcatgttaatatttatttccctaggccgctgtgatgcttaactgagagaatgaaggtacaaatgtattgtaaactatcaagacctcgttattagagattggtgtagtagctaatgctgatatttttaaaatgtttaacagtttcttatgcaaaatacagcagtaaaatttatactgcagtgtcgaacacattcagcacagcttcagactcctggctgtgcgtgaaaactccaagaggataccactggtttatgtcacttgagactccagacattgaacagtaattagggaacatgacagttatttgatttaaagtctgcagccacagagttcaggctccatccctctctccatcattctccctgagtgcaaatccagagggagggcaagtaggtcgaagcagactctgatggtgtttacttacttgccagagattagagaaagtgtgcccactaggtntacagtagtgcaaaaccaagccaaaaagtgagcacttcagtgcactcaatgccantaaaaaaanttggcccaaaaagggccctnttataattttgtncaaaggggaacc

SEQ ID NO: 5225 - DNA, 799 bp, Homo sapiens
  misc_feature (787)..(787): n equals a,t,g, or c
ttccctttcgtttagggacccttccccaaaatacagcagtaaaatttatactgcagtgtcgaacacattcacwtcagyttcagactcctggctgtgcgtgaaaactccaagaggataccactggtttatgtcacttgagactccagacattgaacagtaattagggaacatgacagtwatttgatttaaagtctgcagccacagagttcaggctccatccctctctccatcattctccctgagtgcaaatccagagggagggcaagtaggtcgaagcagactctgatggtgtttacttacttgccagagattagagaaagtgtgcccactaggtctacagtagtgcaaaaccaagccaaaaagtgagcacttcagtgcactcaatgccaaaaaaaaaaaaaaaaaaaaaaaacatgtcttactttttttgtcattactgacttcatgagtagtgcatgtaactatttctatgggtcttctctttgattttttttctctttgattttcaaaaagaaccattaacattttaatgttatatttactgagaggttgcatgatatcagccaaagtaaaagggatatggatgaaataagaaatacagaagtctggccaggcacagtggctcatgcctgtcatcccaacactttgggaagacgaggtgagaggatcacttgagttcaggagtttgagaccagctgggcagcatagtgagacctcctgtctacaaaaaaaaaaaaaaaaaaaaaaaaaaaaaaaaaaaaaaaaaaaaaaaaaaaaaaaaactcgngggggggcccgg

SEQ ID NO: 5226 - DNA, 532 bp, Homo sapiens
  misc_feature (18)..(18): n equals a,t,g, or c
  misc_feature (31)..(31): n equals a,t,g, or c
  misc_feature (49)..(49): n equals a,t,g, or c
  misc_feature (107)..(107): n equals a,t,g, or c
  misc_feature (111)..(111): n equals a,t,g, or c
ggccaaggttagcccccngaaccagcgagtncctaggacagctaaaagngcaccccgtctatgtagcaaatagtgggaagatttattaggtagaggcgacaaacctnccgngcctggtgatgctggttgtccaagatagaatcttagttcaactttaaatttgcccacagaccctctaatccccttgtaaatttaactgttagtccaargaggaacagctctttggmcactaggaaaaamccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagaaaaaaaaaaaaaaaaaactcgta

SEQ ID NO: 5227 - DNA, 1420 bp, Homo sapiens
acttcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggtaaagaaaagagaatgtcactgagtggcctgaaccaaagctcatggatactggagatgaagaaccagcaggagaccccaggcatcaaacagaaaggccttttgctaagtagcagcctgatgcactccgagtcagagctggacagcgatgatgccatctttacatggccagaccgagagaagggcaaactcctgcatggtcagaatggctctgtacccaacggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtcaaaaaaaaaaaaaaaaaaaaactcgag

SEQ ID NO: 5228 - DNA, 2315 bp, Homo sapiens
  misc_feature (2264)..(2264): n equals a,t,g, or c
  misc_feature (2312)..(2312): n equals a,t,g, or c
  misc_feature (2315)..(2315): n equals a,t,g, or c
tttttttttttttgatttttcaaaattaacttttttattaatttaaaaatccagaaatacagtgactacataaataagtaccataattaggtacatgtcctgtgagaacagtgaaagggtaatactgttatgttactcttacttgtttacatgagttaactagaaaatggctacaactgctaaatgatgcttatggtctttgttgttccaagtgtttatgatacaaataaatacacaagaagaaccacatccattcttctctactaactacaggcagcttggcctctttaccctatgtcctattctctacacaacaccaaacactggagggtttctactttgacttaacacagctccccagctcctgcttcccacagcattttgcaaaggtgtgtcccagcacctggaggcaggagtatatctagggaaactctctgcgtgttctcttaaggctaagctttcagagaacacctgggtgggaaggctttgggatgaatcatccagaaggagaaacacctctttgccttaggatctagttactagtctccacattatggaatcactgccacctctgggacggagggagcagccgcataacaccttcccccctttaccacacacacacacacacacacacacacacacacaaaggagcaaattatgctgtgcatggcgtgaataattgactgcatttgagtttggagttttagggcactgttgacttaagcaaaataagcctgcagtccagctgcagcttgagttttcttgctttaccctatccaatactgtctgtcttgcctaacagtggcccttttcagatctctccaggtacaaaaccttgactaaatcttcaagctctgttctgcatacacgacttgaacacatctggctgatctgagcttctccttcggtgaagatcttccactggctcagggttgttctggtcaccagcttgaagtgaggaagctcctcaaacatcctcttggagatcttctcaatatggaagtgctggagaatgccctttcgaatagtccaaacgtggacctctacctgaggtggtctctcagtctccagtgctatttttctggttgtctccccatcctccatgaatacagactcatacacaggcatcgtttcttccccgcagaagtagcctttattgtcaaagctttggcctggaagttcttctggacacaccttgcagcattttccgtctattttttgaggatacttgcaggggtatcgattggggcagtggattttcttacactcttgcttggtgacattacaagtacatagcacacactccacaatgccaaatgcccggaggtttgggtgccaggactcgccatgagaataggtctttccattggaaacacacacttgtccatgcttgtgtttgttattgatgacaatttgcacaatggttcctgatgcttgctgggaatccataagagctccccggtgacttctggccccaggaaagcgggacagacctccagcctgtcggcttggtggaggatcatagtgagagcggtggtaagaatgtcttgcttctctgttggcaggttgccggaagatatcaccatcagaatgttcccatgacagttctccatctcctctgcatacccggcagcaggaatctggaacagagactgggaaggcacaggttaatttggggcaagtcttgagaccacaatacacgtttccctccgaacagctgcactgggtgcattgattgggttgccgattctgaaagagcccttcagctacgaacagctctccatgttggtaagttgtcccattgtactcgcaagacttgctggtcaccttattgttcactgggggtaaggagtcttctgggcagcgagggcagcacagatgaggaatatgcacaggagaaaggcaatgaacatttggacatctgactcggctgcaaagcacattcccattctctgagcagatgcagttcacgcagtaaaccaacccataaggttccaggtaaggatgccatctctcacccactctgtacttcttgtcttgaaacatgcaatatgtctctgaatgttttacttgctctgtttkgcctccttctagcaaaagaaagctcgtgccgaattcctgcagcccggggggatccactagttctagagcggccgccaccgcggtgggagctccagcttttggttccctttagtgaggggttaatttcgagcttggcggtaatcatgggtcatagcttgtttcctggtgttgaaattggntatcccgctcacaaattccacaacaacaatacgagccggaagcataangtn

SEQ ID NO: 5229 - DNA, 1376 bp, Homo sapiens
cccacctttagcgagccaacgagagaacaccgcctgcagctagaacagcctggtcaggagcgtaacggagtggtgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgawaagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5230 - DNA, 929 bp, Homo sapiens
  misc_feature (923)..(923): n equals a,t,g, or c
atccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaattatgaacattagaaatctgtggggcacatatttttgctgattggttaaaaaattttaacaggtctttagcgttctaagatatgcaaatgatatctctagttgtgaatttgtgattaaagtaaaacttttagctgtgtgttccctttacttctgatactgatttatgttntaaccg

SEQ ID NO: 5231 - DNA, 343 bp, Homo sapiens
gaattctcacgcggtgatttaggttttgccctttcggggatctcgattgcttatggattttcgaaattcatcatgggttcggtatcggatcgctcgaatccgcgcgttttcctgcccgcagtttgattctggcggcggcagtgatgttgtttatgggctttgtgccatgggcgacgtcgagcattgcggtgatgtttgtactgttgttcctctgcggttggttccaggggatggggtggccgccgtgtggtcgtactatggtgcactggtggtcgcagaaagaacgtggcggcattgtgtcagtgtggaactgtgcgcacaacgtcggtgggtgggtattccc

SEQ ID NO: 5232 - DNA, 720 bp, Homo sapiens
  misc_feature (6)..(6): n equals a,t,g, or c
  misc_feature (11)..(11): n equals a,t,g, or c
  misc_feature (21)..(21): n equals a,t,g, or c
  misc_feature (24)..(24): n equals a,t,g, or c
  misc_feature (28)..(28): n equals a,t,g, or c
  misc_feature (298)..(298): n equals a,t,g, or c
  misc_feature (686)..(686): n equals a,t,g, or c
  misc_feature (711)..(711): n equals a,t,g, or c
aaatcnctttngggttatggnccncgcncaaagaacgtggcggcattgtgtcagtgtggaactgtgcgcacaacgtcggtggtggtattccgccgctgctgttcctgctggggatggcctggttcaatgactggyatgcggcgctctatatgcctgctttctgcgccattctggtggcattattcgcctttgcgatgatgcgcgataccccgcaatcctgtggcttgccgccgatcgaagagtacaaaaatgattatccggacgactatwacgaaaaagcggaacaggagctgacggngaagcagcctggggggcgaagattgtggctccacccagcatatactgctgcttgacgaattttatcgtaccgccgtgcgtctcgccggtaagcgtattctgtggaatatggtgccgtgcgacgaagaagagcattacgacgactatgtgatgacgctttacgcgcagggcgtgctgacgccaaatgaatggctggatctcggtggcttaagctcgctttctgctgaagagtactttggtgccagcctttggcagctctacaagagtatcgattccccatacaaagcggtactgaaaacactgctgctggaagcctattcctgggaatacccgaacccamgtctgctggcgaaagatatcaaacagcgtttgcacgacggcgagattgnatcggttgggctcgatccatactgnatgatgctg

SEQ ID NO: 5233 - DNA, 2467 bp, Homo sapiens
ggcacgaggagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcaggcaccctctcgggctttgtcaccatcatcttgggcgtgttcatgctgcatgctttcaaagacctggacatcagctgcgccagcttgccccacatgcacaaaaacccacccccttctcccgccccggaacccactgtcattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactgtttccaggagaaaaatctttacccaaatagcaatggtggcagaacttcctggaaacagattcagtgaccaaatacccaagtttacatcagtgcctgcaggttccctggaccttccttctcattcattctttcggtgccatctctatgccgttgggaagaagatggagtctgacccactgaatgtagcacagtccaaggacttctctaagatattggtcattggaagttccttcacaccaattctcctcctgagacggaatctccgttgttgttgttgttgttgttttctagcccaaggatgacatagagctggctcccagaggcccacagagcaattggccatgcctccctatccagagctgacagggacacaaccagtgtaaaatatcctgttgcctttgtcacttcctctttggaggcagaagcaagacctcagctgaccttcttactgtgaaagccacttgatgtctcaggaaaaatttcaaccagctcattccccgagcactccagcctggcagtcagcacctcggcatccacccagtccatcccaccatcaccccttccccctctacttacatcctaaggagtcggtcactgagacataaaggcagtaatcgcagaactggaaacaaaacaataacagagccacagccaaactctggtggccaaacccagtgttgcattttgtcttactctgaaagaagaacagcaaattcactgcttcaaagtggcctggctgccaagctagaatttggcagaacgcacttttctattcctcaaggagtcaaccaacctatgatctggggaggtgggaagaggatgaggagcaaagttgggatttggcagaaggcagtcccaggctctctggatactaggggctaacttttgtgttgactctggtgctcatctgggaacttaggagaaacgagctcaggggtaatttctgggttgcagccttaaaggcttggacagctgtgaatctcaatggccaactggaggtgcagacttggcatggggtgcattctagctgttgaccagattgctaccgagtcccctcctccactgatgagctgcccacactgggaagcagcatgccctgactgttccaacaccacatgctatggggagtacctttggtcccctcacatttggccagaggcatacaaaaaaccagagcagctggagagggagataattactattccttcccttcccatctcctttctagccacaagagtgtgggggttggagaagaaccattagaaagggaaattagtgggctggtgtatctggaaagagggaagacttgatcctcagccccgaggttggtgcagggcctcccctgtgtgactctacctgcactctgtgtttatatcctgtgccctaagtgggccaagcccaggtaaattcctgctggccttggaactccaaggtttggctgaccagcagactggctccctgactcttcagcctcaaatccccagtttttgatgaatgtggatttctgtctgtaattaaaagcaatgcaacaagttggctcttgagaatggcagtaaactgagggccctaagagtgtggtctgacagggtcaagaataaagattacagattatatttacttgaaaaaaaaaaaaaaaaaaaa

SEQ ID NO: 5234 - DNA, 2541 bp, Homo sapiens
  misc_feature (388)..(388): n equals a,t,g, or c
tggggaaacggtccctctagaactagtggatcccccgggctgcaggaattcggcacgaggagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacatttncaacacttccctggtgttccccatctactacgtgttcttcaccacggtggtcgttacctcgtccatcatcctcttcaaggagtggtacagcatgtctgctgtggacattgcaggcaccctctcgggctttgtcaccatcatcttgggcgtgttcatgctgcatgctttcaaagacctggacatcagctgcgccagcttgccccacatgcacaaaaacccacccccttctcccgccccggaacccactgtcattagactggaagacaagaacgtccttgwggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactgtttccaggagaaaaatctttacccaaatagcaatggtggcagaacttcctggaaacagattcagtgaccaaatacccaagtttacatcagtgcctgcaggttccctggaccttccttctcattcattctttcggtgccatctctatgccgttgggaagaagatggagtctgacccactgaatgtagcacagtccaaggacttctctaagatattggtcattggaagttccttcacaccaattctcctcctgagacggaatctccgttgttgttgttgttgttgttttctagcccaaggatgacatagagctggctcccagaggcccacagagcaattggccatgcctccctatccagagctgacagggacacaaccagtgtaaaatatcctgttgcctttgtcacttcctctttggaggcagaagcaagacctcagctgaccttcttactgtgaaagccacttgatgtctcagggaaaaatttcaaccagctcattccccgagcactccagcctggcagtcagcacctcggcatccacccagtccatcccaccatcaccccttccccctctacttacatcctaaggagtcggtcactgagacataaaggcagtaatcgcagaactggaaacaaaacaataacagagccacagccaaactctggtggccaaacccagtgttgcattttgtcttactctgaaagaagaacagcaaattcactgcttcaaagtggcctggctgccaagctagaatttggcagaacgcacttttctattcctcaaggagtcaaccaacctatgatctggggaggtgggaagaggatgaggagcaaagttgggatttggcagaaggcagtcccaggctctctggatactaggggctaacttttgtgttgactctggtgctcatctgggaacttaggagaaacgagctcaggggtaatttctgggttgcagccttaaaggcttggacagctgtgaatctcaatggccaactggaggtgcagacttggcatggggtgcattctagctgttgaccagattgctaccgagtcccytcctccactgatgagctgcccacactgggaagcagcatgccctgactgttccaacaccacctgctatggggagtacctttggtcccctcacatttggccagaggatacaaaaaaccagagcagctggagagggagataattactattccttcccttcccatctcctttctagccacaagagtgtgggggttggagaagaaccattagaaagggaaattagtgggctggtgtatctggaaagagggaagacttgatcctcagccccgaggttggtgcagggcctcccctgtgtgactctacctgcactctgtgtttatatcctgtgccctaagtgggccaagcccaggtaaattcctgctggccttggaactccaaggtttggctgaccagcagactggctccctgactcttcagcctcaaatccccagtttttgatgaatgtggatttctgtctgtaattaaaagcaatgcaacaagttggctcttgagaatggcagtaaactgagggccctaagagtgtggtctgcagggtcaagaataaagattacagattatatttacttgaaaaaaaaaaaaaaaaaaatttcctgcggccgcaagggaattca

SEQ ID NO: 5235 - DNA, 1693 bp, Homo sapiens
  misc_feature (12)..(12): n equals a,t,g, or c
  misc_feature (23)..(25): n equals a,t,g, or c
  misc_feature (44)..(44): n equals a,t,g, or c
  misc_feature (1690)..(1690): n equals a,t,g, or c
ccgggggcgggnaacggaaacgnnnctctcactattgggtacanaagctggacctccaccgcggtggcggccgctctagaactagtggatcccccgggctgcaggaattcggcacgagttgaaacatgcgtaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttawaaaaaaaaaaaaaaaaaaaaaaaaaaaaaaaaaaanaaa

SEQ ID NO: 5236 - DNA, 1450 bp, Homo sapiens
gggcacgagtcaagattgtgaggtccaagagaacagatcagggtcttaagaagattatctttcatagtgcctatttgatggtaatgatcataaatacagtataatagaaggaaaaatatctggtggcttatatgcattggtagtttctcatggtaataagcatttttttttctcttccttttagcacaagtgcatacaccttgatagcaccaaatataaaccggagaaatgagatacaaagaattgcggacaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaaactctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgtataaaaaaaaaaaaaaaaaaaaaa

SEQ ID NO: 5237 - DNA, 1166 bp, Homo sapiens
  misc_feature (1039)..(1039): n equals a,t,g, or c
ggcacgagaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacanctgtaatcccagcaccttgggaggctgaggtgggaggatcatttgaggccaggagtttgagacctgcctgggcaacataatgaaacttcctttccagggagaaaaaaaaaaaaaaaaaaaaactcga

SEQ ID NO: 5238 - DNA, 1875 bp, Homo sapiens
  misc_feature (1392)..(1392): n equals a,t,g, or c
  misc_feature (1394)..(1394): n equals a,t,g, or c
tctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaatttaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcancncccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaaaaaaaaaaaaaaaaaaaactcga

SEQ ID NO: 5239 - DNA, 1873 bp, Homo sapiens
  misc_feature (1396)..(1396): n equals a,t,g, or c
tctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgcaatttaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcasccccngaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaascctcggccctgactattgtcttgattgctgttcctttctggttcaaaataaaatcatttttgtggcaccaagaaaaaaaaaaaaaaaaaaaactcga

SEQ ID NO: 5240 - DNA, 1211 bp, Homo sapiens
  misc_feature (131)..(131): n equals a,t,g, or c
  misc_feature (915)..(915): n equals a,t,g, or c
agagaaagtggagacggacctgagcccgagggagaggcaggcagaggctgaggctgattccaccccagcctgcctgggacaaccctccttagccgcagccccttccagttccctgaggggttctgcccctnccccctctctgggggcaccaaccccccagggtcctgcatcccaccatgtcgatggctgtggaaacctttggcttcttcatggcaactktggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctgggtatattcaggcctgccgggcactcatgatcaccgccatcctcctgggcttcctcggcctcttgctargcatakcgggcctgcgctgcaccaacattgggggcctggagctctccaggaaagccaagctggcggccamcgcaggggccctccacattctggccggtatctgcgggatggtggcmatctcctggtacgcttcaacatcacccgggacttcttcgaccccttgtaccccggaaccaagtacgagytgggccccgscctctacctggggtggagcgcctcactgwtctccatcctgggtggcctctgcctctgctccgcctgctgctgcggctctgacgargaccagccgccagcgcccggcggscctaccargctcccgtgtccgtgatgcccgtcgccacctcggaccaagaaggcgacagcagctttggcaaatacggcagaaacgcctacgtgtagcarctctggcccgtgggscccgctgtcttcccactgccccaaggarargggacntggccggggcccattcccctatagtaacctcaggggccggccacgccccgctcccgtagccccgccccggccacggccccgtgtcttgcactctcatggcccctccaggccaagaamtgctcttgggaagtcgcatatctcccctctgaggctggatccctcatcttctgaccctgggttctgggctgtgmaggggacggtgtccccgcacgtttgtattgtgtataaatacattcattaataaatgcatattgtgaccgttaaaaaaaaaaaaaaaaaaaaaaaaaaaaactcga

SEQ ID NO: 5241 - DNA, 1177 bp, Homo sapiens
gctcaaaatgtttaccaatgttttaagatgtctttatcaagcaaccgtatcagcagagaaaagayatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaaratatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaaaaaaaaaaaaaaaaaaaaaaaaaaaaaaaaaaaaacccccggggggggccc

SEQ ID NO: 5242 - DNA, 2238 bp, Homo sapiens
ggcacgagccggcwckagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaaaaaaaaaaaaaaaaaaaaaaaaaa

SEQ ID NO: 5243 - DNA, 2150 bp, Homo sapiens; identical to SEQ ID NO: 2994

SEQ ID NO: 5244 - DNA, 1579 bp, Homo sapiens
tgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttgcgagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaaaaaaaaaaaaaaactcgag

SEQ ID NO: 5245 - DNA, 3427 bp, Homo sapiens
  misc_feature (3421)..(3421): n equals a,t,g, or c
gttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaaaaaaaaaaaaaaaaaaaaaccccggggggggncccggt

SEQ ID NO: 5246 - DNA, 634 bp, Homo sapiens; identical to SEQ ID NO: 2998

SEQ ID NO: 5247 - DNA, 775 bp, Homo sapiens
  misc_feature (10)..(10): n equals a,t,g, or c
gaactagtgnatcccccgggctgcaggaattcggcacgagcccracccscaccaccaccagaatgcagttccagcttaggaagccacaaacaagccacccaggaggaacaaaacaccgccagcgtggattttcccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcagaaattcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacgktttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccgt

SEQ ID NO: 5248 - DNA, 1250 bp, Homo sapiens
gcccacgcgtccgcccacgcgtccggcggtgcggagtatggggcgctgatggccatggagggctactggcgcttcctggcgcygctggggtcggcactgctcgtcggcttcctgtcggtgatsttcgccctcgtctgggtcctccactaccgagaggggcttggctgggatgggagcgcactagagtttaactggcacccagtgctsatggtcaccggcttcgtcttcatccagggcatcgcatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacartgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcakaatagatactcaatatgtgaatatgtgtctactagtagttaattggataaactggcagcatccctga

SEQ ID NO: 5249 - DNA, 1955 bp, Homo sapiens; identical to SEQ ID NO: 3635

SEQ ID NO: 5250 - DNA, 1679 bp, Homo sapiens
  misc_feature (1679)..(1679): n equals a,t,g, or c
tcgacccacgcgtccggcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaamwaaaaaaaaaaaaaaaaaaaaaaaaaaaaaaaaaaaaaaaaaan

SEQ ID NO: 5251 - DNA, 2478 bp, Homo sapiens
ggcacagcggcacgaggtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctrcggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaattcctgcagcccgggggaaccactagtt

SEQ ID NO: 5252 - DNA, 2535 bp, Homo sapiens
gtaatgggcttagcctgaagtccctcgctgagactgttttgaactttccccttgacaagtcccttctacttcgttgcagcaactgggatgctgagactctcacagaggtaccaggtaatttatgctgccagggatgcccagatttcagtggctctctttcttcatcttcttggataccctttctctaggaattcacctggagaaaaaaacgatgaccacagtagctggagaaaagtcttgggaaaaatgccagggtgtggtcgacatcccatttcgaagcaaaggaatgagcagattgggwgaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctrcggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcatcgaaaggaggagctgctgcaacacgtcagagagttttataacacagacgtggtcacagaggagatgcttcaagaggctgccagcctggagaccagaatctccaatgaaaactatgttcctcacgggctgaaggtggtkcagtgtcacagccagggtggcctgsgctccctcatkcagctkgagagccgytggcgtmagcacttcctggactycatgcagcccaagmacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcaaaaaaaaaaaaaaaaaa

SEQ ID NO: 5253 - DNA, 1133 bp, Homo sapiens; identical to SEQ ID NO: 3009

SEQ ID NO: 5254 - DNA, 1411 bp, Homo sapiens; identical to SEQ ID NO: 3010
  misc_feature (1391)..(1391): n equals a,t,g, or c
  misc_feature (1403)..(1403): n equals a,t,g, or c

SEQ ID NO: 5255 - DNA, 1479 bp, Homo sapiens
  misc_feature (115)..(115): n equals a,t,g, or c
  misc_feature (1475)..(1475): n equals a,t,g, or c
ggcacgagggcgggtggcatcagcagaggggcaccagccaaagggtgtggctacctcactgctggtccccaggcccgggaggtggggagcacacacagtgccttgggtacccagntgggtgttctcccgctgcagaggagacrgcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcctggagtaagcagcgaggaagagcagcactggtcccaagcagaggccttgccctgctgggaccccgggagtgagagcagcccaaggatcccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctgccctgcccttcaccgtggatgttttcagaagtggccatcgagaggtctggatggttttatagcaactttgctgtgattccgtttgtatctgtaaatatttgttctatagataagatacaaataaatattatccacataaaaaaaaaaaaaaaaaaacttgggggggggncccg

SEQ ID NO: 5256 - DNA, 2447 bp, Homo sapiens
atttcttcccgggttttctgcttctccgccccgtgttggaatggtgggggcctgggtgggaatgggccttttgccagcgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacaaaaaaaaaaaaaaaaaaaaaaaaaaaaaaaaaagggcggcc

SEQ ID NO: 5257 - DNA, 2319 bp, Homo sapiens
ggcacgaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaattggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgaaaaaaaaaaaaaaaaaaaaaaaaaaaaaaaaaaaaaa

SEQ ID NO: 5258 - DNA, 687 bp, Homo sapiens
  misc_feature (616)..(616): n equals a,t,g, or c
  misc_feature (647)..(647): n equals a,t,g, or c
  misc_feature (654)..(654): n equals a,t,g, or c
ctactaaagggttcaaaagctggagctccaccgcggtggcggccgctctagaactagtggatcccccgggctgcaggaattcggcmckaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcaagcggccggaagcggcgcggagtttgccgganggggacsgtgcccccagaaggtggaaggarnccgccgnccccttttgtcaccttggaagccaactgtgggc

SEQ ID NO: 5259 - DNA, 1351 bp, Homo sapiens
  misc_feature (22)..(22): n equals a,t,g, or c
  misc_feature (86)..(86): n equals a,t,g, or c
  misc_feature (115)..(115): n equals a,t,g, or c
  misc_feature (1344)..(1344): n equals a,t,g, or c
  misc_feature (1346)..(1347): n equals a,t,g, or c
gcccaccgtgtccacgggcccntcctttcagcaaatgtatccgggcgcccaagctgggaagttgtttgtggtccaaaagctactgnaagcagttccagccccagtgcccggctcntgcaggaaagtggtttcagccaagtgggcagtgcaggaggtgggccagagacactgtttggagtgtgaggggaaccttgtgaccagcagaaaaggatggaggaggattccaaacttcaggagctgggccaaggtccaggggctgctgggcacagtcgtccatgtgtgtgctcagtaggatgagttcacttaattagtctgtgcctcagtttccccagctgcacagtgggctcactaacagtaatctacctggagggttgtgtgaggtgaggactcccgtggtaaaggtgtgcagcctgcagtgcagtgcccggccatggcaggagcagtgcggggagccatcgtgataatggtgttagggtggcttcaggtaggggcgtggctgccggtccatggcacagacttgggagatggccgaggccctgcctcgtgggctgtcaaggactagatgggaacacgcatatggagcagtggcactgttgttattgttattctgtaggagtggctgtgtctggggtagggggacctcagtgccttgctggccaagggaagtgagggtgggtttccatctgggcatgaactgctgacctctgcccaggggttttcctggcctgccagtgtgtgtgtgtcactgacagtggggtggggggcagctcatggagttggtgcccctcarctgtgctttccctggcgtaggttcctggggctgggagcagggtaaagctgcctcaagtcttggttttctcctctgcctcccccgtgtggccgccaaccctgtgccagcaggtggtgcggggatggcttcctgccccggtctctggcaagaaacccttttccctctcccagtgggtctccccaggttgtcagstccatttagtcataagaagatctggggccaggcgcggtggctcacgcctgtaatcccagcactttgggaggctgaagcaggcagtcacaaggtcaggagatcgggaccatcctggctaatacggtgaaaccccgtctctactaaaaatacaaaaaaattagccaggtgtggtggcatgcacctgtagtcccagctactcaggaggctgaggcaggagaatcgcttgaacccagaaggcagagcttacagtgagccgagatcaccctactgcactccagcctggctcgtgccgaattcgatatcaagcttatcgataccgtcgacctcgagggggggcccgagtacgcaattggggaatgagntnnacta

SEQ ID NO: 5260 - DNA, 1688 bp, Homo sapiens
gcgcgcgctccctggaaggagaagtctcagctagaacgagcggccctaggttttcggaagggaggatcagggatgtttgcgagcggctggaaccagacggtgccgatagaggaagcgggctccatggctgccctcctgctgcyscccctgctgctgttgctaccgctgctgctgctgaagctacacctytggccgcagttgcgctggcttccggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaaggtgaggggcagagaggaaactgaaaacccgtggaacagcagagggctggcaggagagggggctcatgtgactgcaatgatccagtacccaggtctccctttccccagcatatcttccccttctccttgattcgctatgatgtcaccacaggagagccaattcgggacccccaggggcactgtatggccacatctccaggttggtggtgttctggtggggtgggcggggtgctgaagctggcacaggaggactggaattggagactggggtggatgggggcagaaggctctgggaaaggtgacaccactcctgaccctggtgactctgccaggtgagccagggctgctggtggccccggtaagccagcagtccccattcctgggctatgctggcgggccagagctggcccaggggaagttgctaaaggatgtcttccggcctggggatgttttcttcaacactggggagggcttc

SEQ ID NO: 5261 - DNA, 553 bp, Homo sapiens
  misc_feature (18)..(18): n equals a,t,g, or c
  misc_feature (94)..(94): n equals a,t,g, or c
  misc_feature (100)..(100): n equals a,t,g, or c
  misc_feature (114)..(114): n equals a,t,g, or c
  misc_feature (503)..(503): n equals a,t,g, or c
tccagcccacaggtgaanccccatggctctcaggccggccaggtccggctccagggactccagaaactctggcgccagcaccagcgcgcgcgcnccgcanctgcggagccagtncagcagggggccccggcgcaggcggtgggcacaaagcagtgcgcagccggccttkgccagcccgaaccagagccacagaaactctgggccagcggggaggagcagcgccacagttgctccaggtgacagagggcgcggctcctccacctctggcggcaccgtcccctccggcaaactccgcgccgcttccggccgctgcatctccggctcccggcgctgcccgctcgccttctccagcgctcccctcgccgctgtcgccgccgtcgggtccccagtcccagcctagcgcacgtaggaaggcgcgtgcagccctgttactctcgcgctccgcctctgagtagctaaagcgccgcgagccgtgaatgagaaaggtgtgcgcggcgcgctgntgggccagttccgcgaggcgccaggccaggctgcagcccccctcgggacg

SEQ ID NO: 5262 - DNA, 783 bp, Homo sapiens
ggcacgagccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcgggtctggctcgctctgccttctcctactataaatccacctcatcaaccttccgcaagtcaccatctttggctgccttcctggccaatcc

SEQ ID NO: 5263 - DNA, 2016 bp, Homo sapiens
  misc_feature (21)..(21): n equals a,t,g, or c
  misc_feature (36)..(36): n equals a,t,g, or c
  misc_feature (89)..(89): n equals a,t,g, or c
acaggaagcagctatgaccangagtacgccaagctngaaattaagcctcactaaagggaacaaaagctggagctccaccgcggtggcgnccgctctagaactagtggatccaccgggctgcaggaattcggcacgagccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggmcccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctygrgkmttctmccggcctggggcccgtgggsaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcmtggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgycaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctycactcattttggtctttccccccaacttttttttttttttgaaacggag

SEQ ID NO: 5264 - DNA, 780 bp, Homo sapiens
gccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggmcccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcga

SEQ ID NO: 5265 - DNA, 1847 bp, Homo sapiens
ggcacgaggtactctgaaagctggagctgcagcacaccccttttgtattgctcaccctcggtaaagagagagagggctgggaggaaaagtagttcatctaggaaactgtcctgggaaccaaacttctgatttcttttgcaactctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggagaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagcttttccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaaaaaaaaaa

SEQ ID NO: 5266 - DNA, 1847 bp, Homo sapiens; identical to SEQ ID NO: 5265

SEQ ID NO: 5267 - DNA, 1438 bp, Homo sapiens
  misc_feature (1173)..(1173): n equals a,t,g, or c
  misc_feature (1278)..(1278): n equals a,t,g, or c
  misc_feature (1318)..(1318): n equals a,t,g, or c
  misc_feature (1396)..(1396): n equals a,t,g, or c
  misc_feature (1421)..(1421): n equals a,t,g, or c
  misc_feature (1428)..(1428): n equals a,t,g, or c
gcaaagaacagccctctcactcctcactgagtccactctgaacgtgctaaaatgggaaggaggcggtgttttgmtgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggntctccgcgtgagatgatcagagatgaggggtcctcagctcggtcaagaatgttgcgtttcccttcggggtccagctctcccaacatccttgccagctttgcaggnaagaacagagtatgggtcatctcaagccctcatgcctcgnaaggctactaccgcttatgatgagcctgctgaaggacgatgtgtactgcgagctgccggacaggcacatccaacagantgcgctcttccaccaggcaggcgangaaggangcaagggcga

SEQ ID NO: 5268 - DNA, 3379 bp, Homo sapiens
atgatattcaagtcgaattcccctcactaaagggaaaaaagctggagctccaccgcggtggcggccgctctaaacctactggatcccccgggatgcaggaattcggcacgaggtctcggctccctccggcacccgcccggcccggctgctcccggctcctcccggccatggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaaaggcgctatttgtacttctaaatactccagtccttttccatgcactggaaggaaggttattttcaaagctttgtcaccaccatacgatacagagaacccttacagtgccaaagttcaggagcagctgaagatcaccaacctcccgcgtgcagctgctgaaacgacagtcttgtccctgtcagagaaatgacctgaacgaagagcctcaacattttacacactatgccatctatgatttcattgtcaagggcagctgcttctgcaatggccacgctgatcaatgcatacctgttcatggcttcagacctgtcaaggccccaggaacattccacatggtccatgggaagtgtatgtgttagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgagggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttggctatgtccaaaacacaaactttagagcaagaagacctcagacaggaaactggaattttttaaagtgccaaaacatatagaaatgtttgaatgcatgggtctttatctaatttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagctatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaccctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaacatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctgaaaaaaaaaaaaaaaaaaaactcgagggggggcccgtacccaaa

SEQ ID NO: 5269 - DNA, 1628 bp, Homo sapiens
gaggaaatatcctctccatgaggcatacaccaagtaaatgactttgtaactttacttcatcctcttcatttacacagggcatacatgaagtaaccaatggaatcctctagggggtatttaaactcccaaaaattctgtaacggggcccttgagcccctatgcttgggtccattcccaaactgtggagtgtactttcattttcaataaatttctgcttttgttgcttcattctttccttgctttgtttgagcgttttgtccaattatttgttcaagacgccaagaacctggsacaccctccaccggtaacactcttacaattatgcagttgtgcagtgcatagcccgtgccactatatgtggcagtgttgcccacttagcaatgaggagcgcatattttcctgcattatcaccaaaacaatgttatcatcttttatttattattatttttttgagtcagggccttgccctgtcacccaggctggagtgcagtgacgcagtctcagctcactgcaacctctgcctgtcaggctgaggtgggatgatcacttgagtccaggagtttgagaccagcctgggcaacatggcaaaaccccatctctacagaaaataattagctggatgtggtgatgcatgcctgtagtcccagctaytcaggagactgagatgggaagatcacttgagcccaggarttagargctgcagtgagctatgatcatgccaccgcaatccagcttgggcaacagaatgaaaytctgtcaaaaaaaaaaaagaagagagaaaagaaaaaggaaagtaaaaattgctaaacacytccaaagtctatgtaggaaatatgtaaatggtggtccatttccaagatgaagtgcctcaagtaggcctgggtctgccagctacagaaggacagaatatcytaggcccttgcttcaatagctggagcctgcttgttggggtgcccttagttgctctcatccgaacctaagagtttagtctagaatgaaaatttactagcctgcaaaatagctcactttatctattcttttatcagcttgcctgactacctaggtcataggtcaaatacttaaaaagcccttgagcagactataattgcaatgcattatgggctgcaacaaaatgcaccgagacaaccctaaagaaaacacccaaaacccctacctggccaggcgcggtggctcatgcstgtaatcccagcactttcggaggccgaagcgggtggatcacttgtcaggagtttgagaccagcctggccaacgctggtctccataatactcagcctatgaggaaccaggagagggacctgcacactagaggataaattgcttgttgtaactgtgcggggtatgcctgcccaccagacacctgatcttgcaagactgtattaaaagtctcacttccgctattctccgtgtctctgagtccattctttgggtttggacgggtgagtttgtttctcacagtctagactctagatgtgaagaactttgatcatatcaccaaaggagatggtggtatgcaattttataagtaaaaatacactagtgtcagttttttttacaagggaaacctgatttgcatctttttaattaaaaaaaaaaaaaaaaactcgtag

SEQ ID NO: 5270 - DNA, 2444 bp, Homo sapiens
ttacgccaagctggcacgagcaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccgggcaaaaccacattcatggggacacttctccaggtttttccatttgttgcaagcctactcagactccaaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaagaaattcaaagggaattatctcaggatcagaagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagactctggacttggagagaagggcgtgccacccttgctgtgcaacatgggagagaagttcttattgttggccatgaaggaaaatcacccagaatgcttctgcaagatactgaaaattctacactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatcccaaaaaaaaaaaaaaaaaa

SEQ ID NO: 5271 - DNA, 834 bp, Homo sapiens
ggcacgagtggtcttccacatgtactcaagaaaatgtctattcctatggtctctgtgttactctgccaggcaccattgttaatccaagtagctctgccaagaacagtagctataaggaagaagagattgtgcttagtggacagcattcttcaaacatggcatcttttcaacttttttttagtaggctttatttttcagagcatctttaggttcacagcaaaattgagtgaaagtacagagatttcccatttattctttgccccaacacaagcaaaacctcacctgttaccaatatcccccaccagagaggtacatttgttataatcaataaacctacaatgacacattgctatcacccaaagtccatagtttacattagggttcattcactcttcgtgttgtacattctatgggttttgacaaatgtcataacatgtatttataattatagaaatatgtagaagagttttattgctctaaaattcctctgtgctccatccattcatccctttcttctcccagtctcttgaaaccactgctactgttacggtctccatggttttgccttttccagaatgtcatatagttggaatcataccgtaggaagccttttcagattggcttttttcgcttagtaatatgcattttaggtttctccatagcttttcatggctaaatagctcatttccttttagtgctaatattccattgtctggatgtaccatagcttatttatctgcttatttactgatggcatcttggttgcttccaatattttgcagttattaataaagctgctataaacatctgtgtgcaaaaaaaaaaaaaaaaaaa

SEQ ID NO: 5272 - DNA, 447 bp, Homo sapiens
  misc_feature (423)..(423): n equals a,t,g, or c
gaattcggcacgaggttaagtgaattctttgttgagtcacaaatcttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctagagtgcagtggcatgatcagggcttactgcagcctcaccctcgatttcctgggctcaagcaatcctyccacctyagcccccaagtarcgggctacagtgcygcgwaccacgcctggccaattttttaaattttagcacaanataagggcttactatgttgcccgg

SEQ ID NO: 5273 - DNA, 2309 bp, Homo sapiens
  misc_feature (2119)..(2119): n equals a,t,g, or c
  misc_feature (2138)..(2138): n equals a,t,g, or c
  misc_feature (2145)..(2145): n equals a,t,g, or c
  misc_feature (2187)..(2187): n equals a,t,g, or c
ggctgctgcaggcgtccggcttggacgaaccgccgttcccagtgctgggaccctttaagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagaaaaaaaaaaaaaaaaaaaaaaaaaaaaaaaaaaaactcgagggggggcccggnacccaattcgccctatagngagtcgnattacaattcactggccgtcgttttacaacgtcgtgactggnaaaaccctggcgttacccaacttaatcgccttgcagcacatccccctttcgccagctggcgtaatagcgaagaggcccgcaccgatcgcccttcccaacagttgcgcagcctgaatggcgaa

SEQ ID NO: 5274 - DNA, 1101 bp, Homo sapiens
gggcgagctgaaacccgagctcccgctcagctggggctcggggaggtccctgtaaaacccgcctgcccccggcctccctgggtccctcctctccctccccagtagacgctcgggcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagcctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatcttctggaggctgggaagtccaagatcraggcgtcagaagattcattgtctgtccttgaagaaagaaamtgytywgaccctgggggcccagtcaatgggtaccagaaaataacagggggccctgggcttatcaacggacgccatgctaaaa

SEQ ID NO: 5275 - DNA, 477 bp, Homo sapiens
  misc_feature (454)..(454): n equals a,t,g, or c
gggcgagctgaaacccgagctcccgctcagctggggctcggggaggtccctgtaaaacccgcctgcccccggcctccctgggtccctcctctccctccccagtagacgctcgggcaccagccgcggcaaggatggagctgggttgctggacgcattggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactkcaagagctgccgaaatggctcatgggggggtacctttggatgaacttctatngcgaaaggggttcctactgtgca

SEQ ID NO: 5276 - DNA, 2022 bp, Homo sapiens
  misc_feature (2)..(2): n equals a,t,g, or c
  misc_feature (2019)..(2019): n equals a,t,g, or c
  misc_feature (2022)..(2022): n equals a,t,g, or c
antgactgggcagcgctgtgaaaatctccttgaagaaagaaactgctcaraccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggrgacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcayccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccrcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaamaacaaaaaaaacaaaaaatncan

SEQ ID NO: 5277 - DNA, 3781 bp, Homo sapiens
  misc_feature (123)..(123): n equals a,t,g, or c
  misc_feature (175)..(175): n equals a,t,g, or c
  misc_feature (3732)..(3732): n equals a,t,g, or c
  misc_feature (3754)..(3754): n equals a,t,g, or c
ggcgccgtgctggaggctgcccagacctatgccagccacacccagcgctgggtggtactgccactgcacagcgccctgtctgtggccgaccaggacaaggtatttgatgtggcaccccctggnagtccggaaatgcatcctctccaccaacattgctgagacctcagtcaccatngacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggkgtgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgagacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcktccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacaggctgagccgggcatggttgctcactcccgtgatcccagcactttgggaggctgaggcgggtggatcgcctgaggtcaggagttcgagaccagcctggccaacatggtgaaaccctgtctctactagaaatacaaaaacttagctgggtgtggtggtgggcatctttagtcccagctactggggaggctgaggcaggggaatcacttgaacctgggaggcggaggttgcagtgagctgagatcgtgccattgcactccagcctgggcgacaagagtgaaactccatctcaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcmctaaatcggaaccytaaagggagcccccgatttaragcttgacggggaaagcccggcgaacgtggcgagaaaggaagggaagaaagcgaaaggagcggncgctagggcgctgcaagtgtanccggtcacgctgcgcgtaaccccacac

SEQ ID NO: 5278 - DNA, 507 bp, Homo sapiens
ttgacgggatccgctcgtagtagattccratgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagargarcatcgactgtacgaaatggccaacttcggcgccagttcaaggactgttg

SEQ ID NO: 5279 - DNA, 2013 bp, Homo sapiens
ggcacgagatgaaccctccttccctgaaggtgggatttcaggaagaccccaccaccccgtttcaccttagtccagggacatagttcccaagtggggcccgtggcctgagggcttctgggaagggtcccgggggggcacttgggtggtgggtggcacttggcgggggcccagccctgacagctggcctgccacagaatgacacagacctgtacagcgactgtctccgaaccttctggacctgcccccactgtggcctgcatgcgcccctcacgcccctggagcgcatcgcccatgagaacacctgcccccaggccccacaggatgggcccccaggtaagcacaggactgtggggacccggccacctctgcccagccgtctgcccatcccatgatggtctcctgtgcgtgtgagcacttgctagagcttcgaggactgacgacctccacccgctggccctggctggtgccacacacaggccttgtcctgaagatcaggagcccaaggcagggagagcctggagcgccacctctttctgtctgcctgtcccctgtggtgtctctgtgttgctgtctttgtctctgtttctgtctctctgtggctatgtctcttgttatttttctctgtcctgcagctatctctgccttggtcacctccaccctgttgtcacccagggatgccacacactggggttcagtgggggagatagcactggggccacatgcctccatccccggctggctgtgtctgcctgtcagtctccatgtctctccttgtgtctttctctctgtctctctcactggcagggatgcggagtaaagacagacctgtgtatttttattaatctgggagggcttcctggaggaggcaaaactgggttctccaaaggccaggagagaacctgagccccacaggtgcctggcatttgggtgcgggtagacctgtgcactggaacacgcccctcacagcctcctccttttcctcccttaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcckcacatgctgatamamactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacaggctgagccgggcatggttgctcactcccgtgatcccagcactttgggaggctgaggcgggtggatcgcctgaggtcaggagttcgagaccagcctggccaacatggtgaaaccctgtctctactagaaatacaaaaacttagctgggtgtggtggtgggcatctttagtcccagctactggggaggctgaggcaggggaatcacttgaacctgggaggcggaggttgcagtgagctgagatcgtgccattgcactccagcctgggcgacaagagtgaaactccatctcaaaaaaaaaaaaaaaaaactcga

SEQ ID NO: 5280 - DNA, 1710 bp, Homo sapiens
  misc_feature (1)..(1): n equals a,t,g, or c
  misc_feature (1594)..(1594): n equals a,t,g, or c
nttattttttttattgtaagtggktcttatggtgcaggaagaaggaaagctagaccctggggaggacttaccaaggcagctgctgctttctggatgggcaggtgcaggcctaacagtgtgtatcagcatgtgaggctttattcacaatccgtgctccaggccctctgcactgggacaggaccacagggctaagcccaggctgggggttcaggcaagagtcctgcccctagtcctgggctggagggcaggtcagctgcacggaggtgggcagggctcctggcccagctcacacgtgctgcttccggtggcgcagcacctctgtgggtgtaaagaggaagtccttcccgcaggcctcgcagtggtagggcctctgcaggacagatgtcttctggagggtttcgagggcagcttcctcagcccctgggggcccatcctgtggggcctgggggcaggtgttctcatgggcgatgcgctccaggggcgtgaggggcgcatgcaggccacagtgggggcaggtccagaaggttcggagacagtcgctgtacaggtctgtgtcattcgtgaggcagttgtaggtgaggaagtcagtgactgcgtagcccccctttgtggggtggggggacagggtggagctgccaaagaggccaggaagatggggggtggctgggatggtctggggtcccacatacatgttctggacttctagccctgtgagccgccggaggctgtaaggaatcttggatgccgtgaattgcaggagttccttgctcagggtggccacctccttggggctgactggcgtatcctcctcctcctcctccagctgctgctgggcctggtgcgccagctgccggtccagggcactttcccagcgggcacggagccgcagggaagccgccaggagtcggatggcactttcactgtctgctagctgcagctccagccagccatcggccaccaggcgggagcagtcaccattggtgtccaaagaccggctaaaaagcaggagggactggagggcagggatgcggacgcagttcaccaggtacggcttgttggtctccagcagggacacgaagctgaggagctggtgtttgctgctcatcttgtccttgtcgtggcatggctttggtggcctggctcagacaagaaggtcagccaaatctgaatgtgactcccagcacgcagccatgcctcggcttccgtcgcagttgctggcctccagctcctgtgcgtgcagcacctcggggctgccagcgaagacgcaggtggggtgcagcacggcgccmtgcttggcctgcgtgtggaaaatctggtctgagtcctttcggctgctgttgaaggcgtcggggacggccagctgtgggtacaggccccggccyagcaccagcttcagcagagccagctgctcgcggctcaggtcctgggctgagctggcagcgcctgcagctggccaggtcatgccgaagcttgaacttcacatcctggatgtccacgccatcactggcccctgggggggctgggccagccctgtcctcgtcactggagccgccgtcctgctcctcctgcagccgcagcaccttgcgcctgcrcnccgcgccctcctcgtgctggcgtttcagctggtgcagggcccggcgctcccggcgctgctgcaaccgactgtagctgtcccctacctgcgcggcctgggccccagccagcagcccg

SEQ ID NO: 5281 - DNA, 782 bp, Homo sapiens
cgcacccgaccccggctcgccgcgtaccccgcgccacctctcggacccacgacggttctcgggcctcccccggcgccaaccgcacgatgttcaactttgacgccttctaccaggcccactacggggaacaactggagcgggaacggcgcctgagggcccggcgggaggcccttcgcaaacggcaggagtatcggtccatgaaaggcctccgctgggaggatacccgagacacggctgccattttcctcatcttttcaatcttcatcatcatcggcttttatatttaatcggagagagaagggaaggggagtgtccccagccaaccccccagaaacggccttttttcctgcctctgaacccttggccattgatagtctacctttgctgggatccgaaggaactgtactccccctgccctccccgacccgcccagcttagccgatgacctgcacatcgctccactgtggtccagaaaaggaggcctttcgatgtctgagaaagaggccccacgctgtagagtcccgaaagcccaggagtgaagggggttcctggagtctctagggtgcttcttccagagtctgtcttcttgcttccagatgtggtcaacttctggaacactcgctgtagctttattgtttagccccaagcaagatttatctcctcctgccccgcatgtgtatggtgggcctctgtaaccttgaaatgtgcaatgtgaccaattgttgactaccaaaagaaaaggtctggggttgtacraaaaaaaaaaaaaaaaaaaaaagggc

SEQ ID NO: 5282 - DNA, 418 bp, Homo sapiens
  misc_feature (372)..(372): n equals a,t,g, or c
ccacgcgtccgcggacgcgtgggcagccatgcgctggcgatggtggcagcggctgttaccttggaggttgctgcaggcccgtggctttccacaaaattctgcacccagcctgggcctargagcgaggacttattcccagggcgactgctcgtattcgcgcacggcgctgtatgatctgctcggcgtcccctccacagccacgcaggcccaaatcaaggcggcttactaccgtcagtgctttctctaccacccggaccgcaactccgggagcgcggaggccgccgagcgcttcacgcgcatctcccaggcctacgtggtgctgggcagtgcaccctccgtcgcaagtatgatcgcggcctactcagcgacgangamctgcgcggacytggcgtycggcctccargamgsccggcacccg

SEQ ID NO: 5283 - DNA, 1348 bp, Homo sapiens
  misc_feature (444)..(444): n equals a,t,g, or c
  misc_feature (1280)..(1280): n equals a,t,g, or c
ccacgcgtccgcggacgcgtgggcagccatgcgctggcgatggtggcagcggctgttaccttggaggttgctgcaggcccgtggctttccacaaaattctgcacccagcctgggcctargagcgaggacttattcccagggcgactgctcgtattcgcgcacggcgctgctatgatctgctcggcgtcccctccacagccacgcaggcccaaatcaaggcggcttactaccgtcagtgctttctctaccacccggaccgcaactccgggagcgcggaggccgccgagcgcttcacgcgcatctcccaggcctacgtggtgctgggcagtgccaccctccgtcgcaagtatgatcgcggcctactcagcgacgaggacctgcgcggacctggcgtccggccctccaggacgcccgcacccgaccccggctcgccgcgtaccccgncgccacctctcggacccacgacggttctcgggcctcccccggcgccaaccgcacgatgttcaactttgacgccttctaccaggcccactacggggaacaactggagcgggaacggcgcctgagggcccggcgggaggcccttcgcaaacggcaggagtatcggtccatgaaaggcctccgctgggaggatacccgagacacggctgccattttcctcatcttttcaatcttcatcatcatcggcttttatatttaatcggagagagaagggaaggggagtgtccccagccaaccccccagaaacggccttttttcctgcctctgaacccttggccattgatagtctacctttgctgggatccgaaggaactgtactccccctgccctccccgacccgcccagcttagccgatgacctgcacatcgctccactgtggtccagaaaaggaggcctttcgatgtctgagaaagaggccccacgctgtagagtcccgaaagcccaggagtgaagggggttcctggagtctctagggtgcttcttccagagtctgtcttcttgcttccagatgtggtcaacttctggaacactcgctgtagctttattgtttagccccaagcaagatttatctcctcctgccccgcatgtgtatggtgggcctctgtaaccttgaaatgtgcaatgtgaccaattgttgactaccaaaagaaaaggtctggggttgtamraaacttgtctttctgtgacttccccaagccgcagtgagacctggtccagggtaagaatgggatcggtggagagcctgtcgttcctcccgctaaggtcagccccctgggacntcctccttatgttgatagcatgtaggagtgagaaaaagtcattgagcataaggaatgagtgttcctgt

SEQ ID NO: 5284 - DNA, 2090 bp, Homo sapiens
  misc_feature (967)..(967): n equals a,t,g, or c
atagggaaagctggtacgcctgcaggtaccggtccggaattcccgggtcgacccacgcgtccgagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaagaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaamcnaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgayctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcrgttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaaagggcggccgc

SEQ ID NO: 5285 - DNA, 848 bp, Homo sapiens
  misc_feature (388)..(388): n equals a,t,g, or c
aattcggcagaggaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgcnaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtgracttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgta

SEQ ID NO: 5286 - DNA, 537 bp, Homo sapiens
  misc_feature (429)..(429): n equals a,t,g, or c
  misc_feature (502)..(502): n equals a,t,g, or c
  misc_feature (520)..(520): n equals a,t,g, or c
gccccccaaaaagaaaggtaattaattatagttcatttcgttttaactaagagttactaaagcatccctggatgctgagaggtactctctaggaggcagaaacaggaccaagcactgcccacttatctccacactatgctaccaattcacctgcagtgggcatgtgctttcaggagttttttgcttggtatagacagttctatgttcgtcttgtttcagcaccctcgtttgaaggacacaaagagctctagggtcatagaaccaactctcactaactgacacagatatcaggatccaacccatgcccacagtattaccccaagtctctaactagctggtgtaaccaataatggaaagaaaaaaagtaatattctgttcttcaacttcaacagagaataatagtgaaagaatggtgatatttttcctaanatggactaacaagtatcctgagttgggaggtgacttccaatagtaaacaataaaataactgagaaaatggagngaggagggaggggagagngagagtgggcacagaag

SEQ ID NO: 5287 - DNA, 2031 bp, Homo sapiens
aggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctaggctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccrttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattrtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttacatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 5288 - DNA, 653 bp, Homo sapiens
  misc_feature (429)..(429): n equals a,t,g, or c
tcgacccacgcgtccgctgattctggccccagactgagcctggatcctagtcacagactgagctttgatgccagttattgactgagccttagtcttggtcacagaatgagccccaaccttggtctcaaatggatatccatgattctgatcacatattgggccctgaacctggctccagtagtggcctcaatcaatcttttcacatctaccattgttctgaaggagggtgaggggaatgaagatgagtcagtgccaggtgctaatgaaagaccccaaaccacaggtgccagtttcttcttcccaggacttaaaccgcatggggtattgtgggaaagagctgggacactgggagccaggtcaacttgggtcccatcaagtgcccagtggatgactgacagctgggtgtaagggcagtctagcagcaaatgncctaacccccttggtctcattccagattggttcccagtggcttgccccacccccttatagcatctccctccaggaagctgctgccaccacctaaccagcgtgaaagcctgagtcccaccagaaggaccttcccagataccccttctcctcacagtcagaacagcagcctctacacatgttgtcctgcccctggcaataaaggcccatttctgcacccttcaaaa

SEQ ID NO: 5289 - DNA, 1265 bp, Homo sapiens
gggcatgggggtttacttttgcmgagctcagaggcacccccaggccctgtctgcttctgacaggccgtaccctttatttcctcctccgtttcatttggctcccagtggctgctctgcggttttgatttccctccagctatggcactgaattcatttatggaaagagacccaccacctaattggcggatgagcttgggcttctgggtgtggcttccttcttgctgtcataagatgctggtggtgacctgcacatttggccactacctcccgctggaatccagccaccatctgtragatggggcatgacgcggtccagtggagggtgcgtgctggagtctctcccgtctccaccacctttgttacagatgttctttccgaacgtaggtctctgccgtctcttacttgtttaaaacgcccagaacccgagtcagccttggcagtgagcttacggcccgcaccaggaggggccagcctgctgccaagatggggacggttccctgggccccgcggtctgcggtgccgcctcccgcttcaccgcacggtgctctctttcccccaccccccctcagaagcgccggcatattccagaggagtcaacaaacaaatggaagcagagggttaagacagccatggcgggggtgaaattggtacttttctattttgcgggcagcgcgcgtcttgactgtttgcaggcaatcaaagtcgattgtgtttttcctcaacaaactgttgtatatttttttttkaacattcacatccgtgtttctctgtcttccttcggcacccagtgagcccagcatgttgcgatggcactgcatggctatggtgggtctgcggtggcggrgacggrggtggggctctggcttgacttggagctcgtgaaacgtgcttgtcacaactgcctgcaagtgtttcttggtctcctcgttaacatgcatgccacccaccccagaacgagtggcctccggtgtcatgcccgtctgcattctgtgacctaatacatgcattttcccatggaaaaatccacccccatttgaaacatcccggattagtgatgagcttctacctagggtttctccagaccaagccaaccctgggttctgagagccttcaggacatgtgtcaccgcagacgacgttttaacttgtagtgctagctgcttgtttcaacttgctccacaaaggaaaaataactattatggtctgggtggcactgggaaaacatcttccatcttctagacttagaagtgagacttttagcctttt

SEQ ID NO: 5290 - DNA, 595 bp, Homo sapiens
  misc_feature (128)..(128): n equals a,t,g, or c
  misc_feature (146)..(146): n equals a,t,g, or c
  misc_feature (222)..(222): n equals a,t,g, or c
  misc_feature (580)..(581): n equals a,t,g, or c
ttgaggttttttctgagtatttcctggttgttccaagttgtccctgggccccatgcacgcacggcaacatgcacccacgctgacacaccagagatgtctcatcgtgatggttccagacagttgaccgncattgttttgtgttgtanactgacaaagtgaagctgacatggagagatcggttcccagcctacctcactaacttggtctccatcatcttcatgntaagttccagaaggttaaggccagacgaagtcaggggaaaccgcaaggaagtgattggcttcagccgggcgtggtggttcacgactgtaatcccagcactttgggaggccgaggcgggcagatcacttgaggtcaggagttcgagaccagcctggccaatatggtgaaaccccgtctcttactaaaaatgcaaaaattagctggtgtggtggtgcatgcctgtagtcccagctactcaggaggctgaggcaggacaattgcttgaacccgggaggcagaggttgcggggagccaagatcacaccactgcactccagcctgggtgacagagcaagactctgtctcaaaaaaaaaaaaannaaaagggcggccgc

SEQ ID NO: 5291 - DNA, 1222 bp, Homo sapiens
  misc_feature (4)..(4): n equals a,t,g, or c
  misc_feature (52)..(52): n equals a,t,g, or c
  misc_feature (78)..(78): n equals a,t,g, or c
actnatcttgaggtgacactatgagaaggtacgcctgcaggtaccgatccgnaattcccgggtcgacccacgcgtccngaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactactaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaaaaaaaaaaaaaaaaaaaaaactcga

SEQ ID NO: 5292 - DNA, 1588 bp, Homo sapiens
actggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcytctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaaaaaaaaaaaaaaaaaaaaaaaaaaaaaaaactcga

SEQ ID NO: 5293 - DNA, 971 bp, Homo sapiens
  misc_feature (957)..(957): n equals a,t,g, or c
  misc_feature (964)..(964): n equals a,t,g, or c
cgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaaaaaaaaawwaaaaaaactsgaggggggcccgtacccaantcgccgnatatgat

SEQ ID NO: 5294 - DNA, 968 bp, Homo sapiens
  misc_feature (241)..(241): n equals a,t,g, or c
  misc_feature (954)..(954): n equals a,t,g, or c
  misc_feature (961)..(961): n equals a,t,g, or c
ggcacgagggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactnaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtatwaaacaaagtcmcttttctccmagttgkatttgctatttttcccctatgagaagatattttgatctccccaatacattgattttggtataataaatgtgaggctgttttgcaaacttaaaaaaaaatttaaaaaaactggaggggggcccgtacccaantcgccgnatatgat

SEQ ID NO: 5295 - DNA, 3259 bp, Homo sapiens
tttgcagtacgggccggatttcccgggtcgacccacgcgtccgcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagcccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttgggttttacagagattgaagatacctggaaagggctctgtttccaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgcacaataaacattgcttgatgttttctatttcagggacccagaacataatgtagtgtatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttctggagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacgcatgtgctgctgcctttgtaactgccatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaaaaa

SEQ ID NO: 5296 - DNA, 3175 bp, Homo sapiens
ttttttttgtcaatcactttaatagatgtccataggtagttcatatgaatgcttaagttacaaaattagctgccatggtccaaatgtatgggactttaggaaagcttttcttactcaaaagataactaagactatcaactttgatttctaaaatgtaatttaaaggtttgtaaaacaaggccactactataattatataatattaaagtaattaagttttatgttagttattttaataacaacttcatgaactgttaaaaatattacatttgcatctctcagtttacatatttctgtattaacttggagaaaaacccatgtgaaaagtttccatgcagttacaaaggcagcagcacatgctgttttcacagcaacttgttattgcctcagaacaggcctgcactaaagcatcaacaaaaaatacccaccaccccactcccaccagaaaacccaacccttacccatccccggcaaaaattacctggtacaagcaatgacctaaaaatgctttcttggtaagaagcatttataaaatgcagagatctgaacaagctaagtgctcgtgcagatacatgggcctctcctccaagagttggttccgcaagaggtggaaagaactctcaatagtttaggaaagctcattttcaaaagtatacttacacatattcatggccatttctttgaaagaacatacccagcctcaactgtggaaaagataaaagcagagggagaagcaacggcacacagccataatatagagaacagagcttctccatgaacatccaccaggctgcagcaaccaagaaggaaaaaacatttgtgatttcacacagaccaatgatcttacctaggtgaagcattaatttttcatgcatttgttactcaagaaaataaacatacaaccacttaaaatacagcattcacgttgtcactggttcgtggtatcaggtaaggaaaaaatgatgctcctgtccctagaattttccatgtacatgtcagtatcctaatgcctacagacttcctattaattttgttatcagcatctcccacctaaaaacatacactacattatgttctgggtccctgaaatagaaaacatcaagcaatgtttattgtgcaattccaatcattatttgcagaatcttggtttagagtcagtctttatagccatttcaactgcttggtttaaacaaaaagcaacaatctggttatctacctataaatttcayggtatttctttaaacactgaagtactaaaagcactgatgatttgtattataatttttaaaatatttaaaacctacacagatttcatagatcattccttttataaaataatcaaaataatttgattatctggaaaaaaaaattcttgaaacagagccctttccaggtatcttcaatctctgtaaaaccccaaaccccaaacagagtagatgatgaaataaggatttctcagttgcccaagactgtctgaaatttaaggttgagaaatggactggcgtttttcatgtttcctgtgaattcagagcttacaggtggcatcagaactcaaatctctgggatggctttacatggctttcactttgatttgtttcattttcatttgcttcttttccaacttcttttkctcacgcctcaatgcagcctcctccagcctgcgctgtttctcaggatcttcctcattcatgattcgctccttctctgctctttttttctcctcccgccgagactgtgctgcttcctgtctttgcacatgtgtcagtttcaagaagttctcttctactcgggcacggttcttatctgctttttgtttgccttctctgttgagtcggaactttttggctttatcaatagaataaatcaccatgttcatcaggggtagcagtgcctccatatcctttgggtaagtgttacctgagccaggcacattaaatgtaaacaacagtgtcctcttagtgtcaggtagctttaaaggctgaccttcctcttgcataatttttggaccagagaactggtctgaaaaatgaacagattcaatcttgtcagcatagtgtgtaagaaagtgaaccatctttgtatccatcattccgtctgtgacttctcccatctctgacaggatggccaaagagtccggcagtccatactttgctccagacttaggtttatcactacaaaactcactcaaatcctgcatctctttctgtagtcgcaccaaggctttccgtgtgccaacagcaaatacgtaggtatccatgtcttcatcattcatggttacttttatttgcacttgatcactcactggcctcatcatccgggccaggacattcagtaagtcttgtctcttgaggaacctcagctggataagcatgccctcacagcacactcgaccagaacaccacaggttatagatgtgctcattctcctggttcaactttcctgtgcttgtggcttctttgttagttccatcatcccccactaaagtaaagttgctctccaaaagctccctatgagtgttaaaccaggcctgtgcaaggcgactgtttttattcttcccaatgatgtaattcatgatataagcaagcagaccagtcaccatcaaaatttctagataataactctcccagctgttctggaggtgtgcaggaacatcaacaatcgttattgggtctttatttttgctagaagaagtatctggtttgtcttcataaccttcaaattcttcatcatcatatggttcactctcagtatctccctcctgggtatctgcatcttcaaaatctccttcttggttttcatcctgcccttccaactccacagtggtctcatcttcatcatcttcagtgattatgacccgttgaggagattcagtaacagagtcttccatgacatcctcaaattcagcgaagtcattatcatcatactctactatgtcctcctcatcctcaaaatcatcaaacttggcttcagagacactcccaaacaccagaaggacaacacagaaagtgtggaaggctttcattgcaccttgagaaaaaaagctgtggccgaagccgaaacccggcccagcgccctgcgtccgacacccctgcccggcctgctctcggcctggccgccgcctccgcgatcgcagcggttttactgccccggatgcctctaggacgcagccagaacc

SEQ ID NO: 5297 - DNA, 4259 bp, Homo sapiens
  misc_feature (3)..(3): n equals a,t,g, or c
  misc_feature (4196)..(4196): n equals a,t,g, or c
tcnagctcgaaattaaccctcactaaagggaacaaaagctggagctccaccgcggtggcggccgctctagaactagtggatcccccgggctgcaggaattcggcacgagtcgcgagcatcaagatgctgcacaacgcgttcctgttcgtgttgttcgcgctggtgtcgggttacggcaactacgcagccaccgcgcatgactggctttacgaaaatggccagctcagccgcaaggaagcggacgcggtgctgtaccgtgcgctgcgcgctgagggtgtggcgcgttggcgagcttggctgatgtatgcaggtgtccgtttaggcggtgccaagcaatacaagaccccgacaagttcggggttttcttcgtctggagattgaaaagacgaagccccggcgagctgtaatcaccagggcttctattttctctgatcgggacatatcgagaacgtcctgcaatgctaccagcgcgccaggaaaagcaaaaccctgacggtactcagtcgtcagggcttctattccctcctgcagggtgtgctataggggggcgtgccgggatgatatcaacgatgcctcggcaaatcaccccacctatcgaccacaagtttcagctatccagctcgccaagtgcgggttttttttcgcctggaggaaagtatgcacacatcacaaaagggcgtaagccttatcaaatcgttcgagggtctgcggctcaactcataccaagactcggtcggagtgtggaccattggctacggtgcaacgcgcggcgtcaccgccggcatggccattaccaatgagcaggccgagcggatgctggtgaacgatattggccggtttgagcctgagattgagcgcctagkgaaggtggcgctgacccagggccagtgggatgcactggtgagttttacctacaacctgggcgccgccaacctcgggtcttcgactctgctgaagctgctyaatgccggcaactatgctggagcggcagatcagtttccgcgctggaacaaggcgggcggccaagtgctgacaggcctggtcaagcgtcgcgctgctgagcggtcgatgttcttgggggcggcatgacgcccgggaacaagctgatcgtcctgtgcctgggcgttcttctgctattggtcatcggcgccggcggcggtgcctggatcgcctcacggcattaccgtccgctgctcgatgccgccaacctcgacttgtccaccaccaggtcagcacgggacaaccttgaggcgctggcaggggarcagggcaggaagctcggagagctggtgcaggccggcgatctgcgggagcggaatgccgcgctggcccaggagaaagcaatgcaagaggcccarccagactactccgcarccaatcagttgctgcgggagcgaaccggcggtgatcctgcccaggctgccgccgccatcattgatcaggagttggggctatgaggcgaattaccggctttacacttggtgtaatgatggttatttggtgttttgcactgaccggctgtgtggcccgagagcccgaggtgcgcaccgttcgggcggaagtgccggtgctggtaccgtgcaggacgaaggcggtagcggtgccgccctgggctgcggagggcctgaagaagtccgatagtctggagctgaaggtgcgcgcgctgctggctgagcgtcgacagcggatcgggtatgascgggagttggtcgcggcggtgarcagctgtcaataacargcgaccaaggtctgatcgcactgcgggcttgccaggcgtacgttatgtcgcgttaagctgtactacacggaatgaaccacgcataaggaaaggctatgagtgaggattttgtagggctgggartgctgctggtcatyccctggatggttgccattgcgcttatcatttacgtagcggccaagtagaaaagcaaagccccggaggttcgcggctccagggcttctattttcgcctccatcccttaatggctgacgaacgtggctgggagattaccagcgactttcggatatttcactacgactataggagattgtaatcggtcggccggacgtcgggggatgggtgtttcaggcacggaacgaaagatgcgcacgttacttactgagcgccggcagcagatcggataaaaaaaggggagtcgttgcggtggtgagctgccagtaacacgcgatcaaggtctgatcgcgctctgagggtgccgggcttatgatggcgcacagagtcagctacgctyarttggtcggcctacagtgagagccatcaacatccatccaaacggsaagggccttgtggataaaaaactggcggggctatcgttcttgttgactctctgctgggtaattgcggtgattggtgttatgtggatcttcagctgaccggtctgcctatcactcaggagtcatcaggcagcaagagttagcttgatgaattcgtcattgtaatcaagtatttctagtgcgccacggacgttcgcggttgcttcgacgccgccgtgtcgctcgacccattgcgcgagttccatgatgrcggctcctagggcgacttggttttcgttgagcttggaaaaaagggtaggtagtaaatctgaattaggcatggctggtactcacttggagtgagcagcgtagcactaagagttctctgggagctgtgttcggtcggcaggacgccgggggatggcgaatcaggcgcgggacaatcctgggacaccagatgtcccaaatagccatgaatgaagatgaatcattatcaggcgaaagccaataaatacaggtggttgagtcagcccgcccaataaaatggcagattgaaaacggattgcaaatccgcctacgccggttcgattccgacctcggcytccactcttaaagccccgtagattaacgtctacggggtttttwattgcctgcggtttggtcattgcytccgcagctttagggatcgctgccgcatccctagctttttttgggagatttaagacgcctctatcggtgtgtctcttcctgattggacgtggagttgtactctaagactaaggagtctgagcgtccactaacggccaatagcggactgtccgctcggccagaacttggccgcgcttttcatctggcgactcggactgacaaccttcgaatgcttcgttaaccccctaatgccgtcacattcatcttgtctgggtcgytggcatccgccggcgttttaamccttgcggcgtctctgcagcggcaacccgaataagcgtgcgtactcccggctaaattgcgaggcgctttcgtagccgacagtgaatgcgatggcggccgcgttgtgtgtttcgaatagcaggagccatcgcgctctgagtaggcgcaggcgcttttggtattggatcggtgtcatcgccgtaatggctttgaagtgccgatagaacgccgcgacgctcatgtcggccatggccgctaaaggttctacacgaaagggctcggtgtagtgctcgcgtatccactgggtggctcggcggatctgtgaaagtcggccatccgggcgagctatctcgcgcaacatctccccaaagggtccttgaagcgcacgaaacaaaatctcgcgttcgatcatcggggcaagcaccggcgcctcatcgggatggtcaatcaggcgcagcatgcgcaaccaggcatcgagcatttcaatgggcgccaaaacaggcgcgaagcaactggggtgaggctgactttccgcttttggtctatccgccaacagcgaagcgatgatgctggggtccagggtcaagctgatggcgaggtagggattgtccggcccgccagggtaaatctccccggtcgccggtacatcaatgggcaccacaaaataggtggccgctccgtaactcagcacctggtcgccaattgacaaggctttcgagccttgcagtacgaggtgcagcatcggctggtaaacctggctggcacaagcctcggcattcaccatcgccacacgtggcaacccggttcccgtccactggctttgagcacgcatcacgatactgcgcagttcattcatggtgtcgttcatgtgagcgacgatggcgtagaccgatgtataaagcaatgcagatgagaagaataggcaagagtgcgagaggaaccggcaacggctttacgcggcgcggacccaatactgatggcaagcagcgttaggncttcgggactgatcggaggtcaataacggacgctgcgtcacttgccactttagacggcacgag

SEQ ID NO: 5298 - DNA, 1338 bp, Homo sapiens
  misc_feature (519)..(519): n equals a,t,g, or c
ggcacgagggtgaggcccaggtagcgtttgcaatccagccccaccgtcacctcttttcttggacttctagttttcctcacccctattgccttcatccttttacctccgatcctgtggagggaatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctcttttgtggtttccctattggcttttttacggggtccgcattttggactctcgggaaccggaattaccaagggattgtgcaatatgcagtctccccttgtggaatgccctcctccttccatccattactggccatccgtccctgctggagctcagggagcttgcagcccaatgttccacgctgcaggttggtcccgctcccaaccgaatggggaaatccccgcttccagcntgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcaagcacctggccttctgcatcaccaacggcatgacccccaaggccttcctagaacggtacctcagtgcgggccccaccctgcaatatgacaaggaccgctggctctctacacagtggaggcttgtcagtgatgaggctttgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaaaaaaaaaa

SEQ ID NO: 5299 - DNA, 2594 bp, Homo sapiens
gaattcggcacgakaaggtttgatgccagaattgatggctctcttccggccgatccttctcccagcgccaggtgcatggtggtggccctgtcaccatgctctgtgtccttctggctgtggctttccagagcagccccattccaggtgcagcagcttagaattgcagtcagcctccagacagtgctggttacagtggcttggtgacattagacctttattgttgcaaggaagagaagtcacttgagtcagcagcccagggcatttctctgctgccatcctcctgccatttgctgtgccttccatcctaaggtcacctcttgggctgaggaggtagttggaggcttagtcacctctgccttccaggcaagagaagggaaggatgaggccaggscacccgccggctgtcctgttcccgtattgaacgttcccaggaattycagccgcaacttccttcttcacatcatggaccagaactgagtctgaggccacctgggtgttaggggagggctgtctcctcgaagaatgctctgctgcccaggcaggatgtggggctttgtcccaagggagaaggagggaatgggggggtggctgcaatcctgcctgctgggggctttgggtcctgctggtggcctctggggaggggctgagacaagcaggtggctgaggctagagcactgagcatggttgggactttctaggaggtcagggcagagctggctycgggccttgccaccaccgacctcactcttggttctcccctcagtcaatgccgtgtgccccgaggctgagctcttcgtggatcccaagatgcagcckcccaccgagagccaggtgacctacctgcgacagatcgtgacggcrggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgctcggttcctgctggaagggcaggtcttccgcaagctggcctcataccagagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccaaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcacccaraaaaaaaaaaaaaaaaaaaaaaaaaaaaaaaaaaaaaaaaaaaaaaaaaaaaaaaaaaaaaaaaaaaaaaaaaaa

SEQ ID NO: 5300 - DNA, 2527 bp, Homo sapiens
ggcacgagtcacagctgaggaagacctcagacatggagtccaggatgtggcctgcgctgctgctgtcccacctcctccctctctggccactgctgttgctgcccctcccaccgcctgctcagggctcttcatccccccctcgaaccccaccacccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggaatgggcttatccttggagaggcacctgccaccctgcggtcattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggtctgggatgccccaccccaagggggctccagccttcagttgaaccggtgagggcaggcaatgggatgggagggcaaagagggaaggcaacttaggtcttcagagctggggtgggggtgccctctggatgggtagcgaggaggcaggcgtggcctcccacagcccctgggcctcccaagggggctggaccagctcctctctgggaggcacccttccttctcccagtctctcaggatctgtgccctattctctgctgcccataactccaactctgccctatttggtctttttatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgtggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagataaaaaaaaaaaaaaaaaaaaaaaaaaaaaaaaaaaaa

SEQ ID NO: 5301 - DNA, 2508 bp, Homo sapiens
tcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccaggcccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggtcattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgatgagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagcgaggaggcaggcgtggcctcccacagcccctgggcctcccaagggggctggaccagctcctctctgggaggcacccttacttctcccagtctctcaggatctgtgccctattctctgctgcccataactccaactctgccctatttggtcttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagataaaaaaaaaaaaaaaaaaa

SEQ ID NO: 5302 - DNA, 3240 bp, Homo sapiens
ggcacgaggtgggtgcttcaacagcacacggcttgcttcttccgctgctacacatccatggtgggtcagctaacagctctgctccacatcaccccaacccctggccccaagctgatagagcatggtctcattatttataacactggcaactggtttgatagagggagagaaagaggttgtgatggcacactggctcttgaagtgccctcttggggatgacacatcccagtcttactcaatttcaaagttgcgtggatatacgtaacttccaagcaggggagagaggtcatcctaccgtgattctggaagctagaaccagaaatatttggtgagtagtactaataacctcctgttttagttatctgttgctgtgtaacaaatgactccaaaacctagcggtttaaaatcataaccattcatttttctcacctggcaacccgggagcagcttagctgggtgattctggctcagaatctctcatgaagttgtggttaaaatgtcagccagggctgcaggcatccgaaggcttgactggggctggagggtctggctccaagatgccactcacatggctgctggcaggaggcctcattgctttaccatgcagatctctccaatgagctgcctgagtgtactcatgacatagaagctggtttgtcccagagctaatgatatgagagagagagaaggagaacaagcaggaaactgcagtactgtttaggacctcacacacatgacctctgctttattttatgcatgagaagcaaggcactaaatccagcctacatttaagcagagggaaattaagctccacctcttgaagaaaggagagtcaaagaatctggggtcatatcttaaaaccaccacacctacaatagttccccaggtgaccatcacagggctgcagacccatctggccctggttcagcccaggctcttcatttgtatccgggggcctctgcatctgtccctgtccctctccaattgagacaggaggagaagccccaggagggtaagaggaggagagtgcacacctttcaaaacagtctcatggtaaacagagacaaagagagagaaggaagggaagcacatgagcctttggcgtctttaaaccttaatattctgtggccccctctccaaactgaggatgccctctgacagctgtgtgggctgtcaaggaagatttgaaactcttcctacccataagaacttcctccctggctgagcacacttcaccactggtgggtgtggcctgttggagtcaggggtctctgcccgggcagacagaaatgctccttgtgcagaaagtgagtgagcaggtgggctcctcactacctaagtacacactaaacacacaagcttcccaggggatgggaatcgattttgcgctacaacaaaatatacctatccctttgagttatgagtgaaacttcaggactaaggctctgctatccatcctggtatatgtagactcccggcagcaatttgaaacgatcagagccagagacagagaggacagagtaaaggccctaagagaaagcccaacaggaagtcggcaaattgagtgagggagtcaggagatgggcaaggctcgcctggccacgggcttgacccagaggctctagcttgcgatgggcaggaaagttttcacacacaccctttgatggcccacacagacgtcagtggggcatcctcagtttggagagggagccgtgagaataccacatgtagaaaatgaccctgccctggttgtttagaaaagctgtcaggaaggtcagtggtcttctattaacctccatctcctgtatttctagaacagctggggtagacaggggaggtgttttgggttctcacctttcctggaattctggcctagtgagagctcagtgactgaaggctcccttctgggaccctcagggggctgcatgtaagtggggagggccggggcagtgctggcccagaggacaggcacacagagtgcagtggggccactgtgggctggggagggttgctggccacaaggcagcagatttcctgacatagccttactatttactttttggtcaataattggaaaaagtattggaaagagagaacatatggaatttggcctaaagaaaagttcaggggacttactggagccagtagtctcgtcctacaagtgatgctctatgtggctgagaactgggctggagggtgctggaggtggcctgaccccaggaaagccttgtctgtccatgtgcatgaggtggaaagccccaagggactgagcttcccctccagagccgttgcccctcctcctgggcagcaagggtgggaaacggttaccacagcaatgccccagggctgccagagcttgttcagcctgggccaggtcctttcttgggggtagctttttcccttttaattattttttttctatctctcctgctactaagtcttcgtgtcccccttttgcgaacagttgagactttgctttcaatgatgagattgacccctggttgcccatcaaaaagtggtgaatgaactcctggtgggactgatgattggtacaactcatgggaaatggtttgggagaatctaccaaagctgcacatcctctgtggcccgggaagttcactcctaggttcaccaaggaagaaagtgctttcacccagagatgtagatgagaatgttcatggtagctttattcctaagagccataactgggaaagaccccaatgtccgtaaaaggcagaacagatacataaatattcacacacaggaacactaactgcagtgaaaatgtaagagcacaactctacagagcaacacagatggacctcaggcacgcacccttgagaaaaagcgcctgccagccagagtgtatgtaacattcatagttccagttatggaaaatccaaggacaggcaaaaccattctgggggatagaaattagcacggtggctccctcaggtggggtcttgacagggaggggtctgagagccttcaggggcaagaaatgttctatttcttgatattggtggtggttacacagatatacacacagatgaaacattcatcaagatatgcctttcagatgtatgcactttaatgtacgtgtgtgatatttagacagtaaaagaaaggtaaaagaaggggcaaacaggttttctatatgttctgggctttttggagtttttaagcgatgcttccttaacaatgaagaattggccattccataaaaaaaaaaaaaaaaaa

SEQ ID NO: 5303 - DNA, 1558 bp, Homo sapiens
cgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgcgtgccccatgtccagggggaacagcaggagtgggaggggactgaggagctgccgtcccctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggcgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccagggctcagcaccaggctgaccccaccgcctcttccccgatccctggactccgactccctggctttggcattcagtgagacgccctgaccacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaaaaaaaaaaaaaaaa

SEQ ID NO: 5304 - DNA, 3140 bp, Homo sapiens
  misc_feature (3)..(3): n equals a,t,g, or c
  misc_feature (5)..(5): n equals a,t,g, or c
  misc_feature (21)..(21): n equals a,t,g, or c
  misc_feature (1628)..(1628): n equals a,t,g, or c
  misc_feature (1642)..(1642): n equals a,t,g, or c
  misc_feature (1656)..(1656): n equals a,t,g, or c
  misc_feature (2094)..(2094): n equals a,t,g, or c
tgntncgagtcacccaggtgnagaatgaggagaaactgaaggagctagagcagatttgatcccaaactctttctkgttttccttcttggacttatgctatttttttgtggagacttgctgagcagaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcrgtgactttagaataattattgatttaactgttttgggaggaaaatagatttttattgttttgttttttaaatgaatgtcttttaaaaamcwtamcaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttangaacatgcctgtangctcttctgcaggntgagatgttctgggctttttattatattcaactttcaattccatcttaaaaaacatttgtwttcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccanggaaatargctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctawaagggtgacttttccygatcatgtctttatttcaatgagaaagcactgtgaaattgtgaaagawtctcctctttctctgtttaataaacccccatgaaatataaaaaaaaaaaaaaagggcggccgctctagaggatccctcgaggggcccaagcttacgcgtgcatgcgacgtcatag

SEQ ID NO: 5305 - DNA, 322 bp, Homo sapiens
  misc_feature (314)..(314): n equals a,t,g, or c
ggaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagmtccgartamatagttccagattggttcgagtcacccaggtggarraatgargargaaactgaaggancttagaac

SEQ ID NO: 5306 - DNA, 3140 bp, Homo sapiens; identical to SEQ ID NO: 5304
  misc_feature (3)..(3): n equals a,t,g, or c
  misc_feature (5)..(5): n equals a,t,g, or c
  misc_feature (21)..(21): n equals a,t,g, or c
  misc_feature (1628)..(1628): n equals a,t,g, or c
  misc_feature (1642)..(1642): n equals a,t,g, or c
  misc_feature (1656)..(1656): n equals a,t,g, or c
  misc_feature (2094)..(2094): n equals a,t,g, or c

SEQ ID NO: 5307 - DNA, 3377 bp, Homo sapiens
ggcacgagctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactccagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctggggatgcagtggagaagtggctgaatgacttgctgtgcctggattgcctcaacatcactcggatagtctcaggctgccccttgcctgaagcttgcgaactgtactatggtaatagagataccctcttttgctaccacaaggcctctgaagttgtcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagacttttggtggtctgtctggtggaagggtcctatcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccaaggaggcttggcttgcagcctttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagaaaaaaaaaaaaaaaaaaa

SEQ ID NO: 5308 - DNA, 3377 bp, Homo sapiens
  misc_feature (2750)..(2750): n equals a,t,g, or c
ggcacgagctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactccagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgcatgaggtttccctccaggagtcaatccgatacgcccctggggatgcagtggagaagtggctgaatgacttgctgtgcctggattgcctcaacatcactcggatagtctcaggctgccccttgcctgaagcttgcgaactgtactatggtaatagagataccctcttttgctaccacaaggcctctgaagttgtcctccaacggcttatggccctctacgtggcttctcactacaagaactctcccaatgatctccagatgctctccgatgcacctgctcaccatctcttctgccttctgcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagacttttggtggtctgtctggtggaagggtcctatcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccaaggaggcttggcttgcagcctttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctgnaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagaaaaaaaaaaaaaaaaaaa

SEQ ID NO: 5309 - DNA, 571 bp, Homo sapiens
ggcacgagtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaaccaaaaaaaaaaaaaaaaaaaaaaaaaaaaaaaaaaaaaaaaa

SEQ ID NO: 5310 - DNA, 680 bp, Homo sapiens
aattttttgtattttttagtagagacagggtttcaccatgttagccaggatggtctcgatctcctgacctcgtgatccacctgccttgggctcccaaagtgctgggattacaggcgtgagcmaccacacccggccaatcatattttttcttgttactaattagaatcatgattctcctggcattcttcattttgttatacctcacttccttttccttagcaagatctttgccatagagtatggaaaccaggttccttgccagttaatctgtattgtgctttgtcatgtattgttactaaacagctcaagatcaaggggaagaaatgtatatgaggctcagttcatgttcagttttttttttttcagcattgcaacattgccactcatcatcatgagtgtagccctgtgtcaggtactgaaggtaatggaaaaggtatataaggttgatccctgtactcttgttgggaacttgagtggtatgaatagagaaggtgagttcttggggacagaggctacagtttagcaagctttcctatgcggaccttggtaatttctttacattttatagaccaaagaacaatcttaacttgcccttttttctaaaggcattgtttaaaaactgtcatcaaatcattgcagtttatggcaaatggcctttttttaaaaaaaaaaaaaaaaaa

SEQ ID NO: 5311 - DNA, 2232 bp, Homo sapiens
  misc_feature (715)..(715): n equals a,t,g, or c
ctcccaggcccgcgaacttggccattcagccgccgctgtccccgctgcgcgccctcgcgcctctgcctgaraagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgcttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcangggtggcttgccaaggaggaggggaagcagcaggaaaagccagagggggcagagaccaytgctgytaccaccaacggcaktytcagtgacccgtccaaagaagaagcgtgctagccagtcccactcgtgtgataacccattaatctattaagccataagtggattaatccattcctgaggacctgagccctcacgacccaatcatctcttaaaggccccacctctcaatactgccatgcagaggattatgtttcaacctgagtgtttggaggggatgttcaacccataggaagtggcagtgtggaagaagtgctgctgaggagtgagtcactgggggccattttgagaaaacagaaaggagaagccagagttggggagatgaaagcctcatggcttggtttgtcttaaactgccccacagaaggcgaaaggaatgcttgaggctggaccacgtgggtctagcgtgtactgcgtttctggtccccagcccctgttttaccttttgctcctcctgccccatcaaccaagtgtcttcatttgtttctatggcaattaacttttggagatagaagtcccagcacacgagatccccaagcacattatctaccttgctgaacaggctggcagtcacacatgagccaggcgacccagggaaatgccagcccaaacgaagctgctgccacatccagagagggccggactctttctcccttgtagtcactcaagctaatcatccaaaacctgcatcctccatctccaagccccatcttattagcaccatctgggattgccaaccaagaaactgttttatctgagaactctaagaccaaagaacaagatttatttcctctactacagatttggcagtgacgcataaaaggcccatttctcaggaagaatacatgtcctaaggatgtaaaaaaaaaaaaaatattagatctagttaccatggkctataaactggtcttttcccgccccaccctgatcctggcttctgtccaccctcaaatagctgtttgktcataaaccctaaatactagataattctaagttggaaggagacctctaagtcactgtagcatttccaaatcgccattcccaagagacatgtggatctgacatcgtgttttattcttgactgagcctcgcayatttgttctgtgtggaacaaaggcaaaggcagcccaagaacccgggtccttgcctacagtcagctttaggaaatgattgtgaacttgggaagcatttaaatagcaatactagacagtaaatggaaaaggccaaagtcagaaaataagtagggattccaaaggaagcctttattggttgggctaggctgggctagctgtggaagatagacttctatgtccctgccccaaccacaattttactttaattattatgtaattagtgaatcgatgtctgtcaccgtctgtagatgctgaggtcttgttcatctctttatttgcattgatatacatagccattgctcaataaatatgtgacccatgaaaaaaa

SEQ ID NO: 5312 - DNA, 356 bp, Homo sapiens
ccacgcgtccgtaaaactccacatttgtctgcatcagggaaaatgcatgggcacacatcctccctccctccctctctactctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaaataagtttattcatgacacatttacatttgatcataaaaaaaaaaaaaaa

SEQ ID NO: 5313 - DNA, 1710 bp, Homo sapiens
  misc_feature (304)..(304): n equals a,t,g, or c
  misc_feature (638)..(638): n equals a,t,g, or c
  misc_feature (948)..(948): n equals a,t,g, or c
ggcacgagccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagagctgccagaggctctgtgattggctgcggcacgatgacccgcgcacggattggctgcttcgggccggggggccgggcccgggggacagaatccgcccccgaaccttcaaagagggtaccccccggcaggagntggcagaccttaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcacngggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcangctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggakccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcaggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctcaaaaaaaaaaaaaaaaaaaaaa

SEQ ID NO: 5314 - DNA, 2246 bp, Homo sapiens
ggcacgaggccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaaggaaawtaaaaagcttaagaaatttaaaatgctagctgctcaagrgttttcagtagaatatttaagaactaattttctgcagcttttagtttggaaaaaatattttaaaaacaaaatttgtgaaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgctaagaggtagtaaatgtaagagagtactggttccttcagtagtgagtatttctcatagtgcagctttatttatctccaggatgtttttgtggctgtatttgattgatatgtgcttcttctgattcttgctaatttccaaccatattgaataaatgtgatcaagtcaaaaaaaaaaaaaaaaaaaaaattactcggtcgcaaggga

SEQ ID NO: 5315 - DNA, 1268 bp, Homo sapiens
ggcacgagcgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagcctgtcctccgttattttagtgtgcttccttctcttgtctggatttctgcattgccctaggaagtctgccagtatgtgttgatgaaggacaagacaggaaagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggataggcctcctgatgaagctgcacctgaaatggctcttcagagtctccgctttgtacatcctggaatccattttcttcacctagaggtgaccagatttataaaaactgactgattgaccaaactgaccaaagactgatttataagatgtcaatgttttgatttacactgtgatattgaaagaggctctgtggcttatgtctgtaatctcagcgctttgtgatgctgaggcaggagaattgcttgaggccaagagtttgagaccagcctgggtaacaaagtgagaacccagctctacaaaaaaaaaataataataattagctgggtgtggtgacacacccagctcctcaggaggctgatgctggaggatcgcttgagcccaagagttcaaggttgcagtgagccatcatcacttcactgcactccagccagggcaacaaagcaagaccctgcctcggggggaaaaaaaaaaaaaaaaaaaaaaaaaaaaaaaaaaaa

SEQ ID NO: 5316 - DNA, 1268 bp, Homo sapiens
ggcacgagcgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcagcaggcatcttcaaagaatgatatttccaaagtttgcagaaaagaatatgagcctgtcctccgttattttagtgtgcttccttctcttgtctggatttctgcattgccctaggaagtctgccagtatgtgttgatgaaggacaagacaggaaagaatgctcttttcagttgcattagcagaaatgaaatgggctcggtttgttgcagttatgcaaggtcatcacacaaactgccgagaatactgtcaagccatttttcgaacagactcttctcctggtccatctcagataaaagcagtggaaaattattgcgcctctattagtccacaattaatacattgtgtgaacaattatacttcaatcttatccaatgaggaacccaacggataggcctcctgatgaagctgcacctgaaatggctcttcagagtctccgctttgtacatcctggaatccattttcttcacctagaggtgaccagatttataaaaactgactgattgaccaaactgaccaaagactgatttataagatgtcaatgttttgatttacactgtgatattgaaagaggctctgtggcttatgtctgtaatctcagcgctttgtgatgctgaggcaggagaattgcttgaggccaagagtttgagaccagcctgggtaacaaagtgagaacccagctctacaaaaaaaaaataataataattagctgggtgtggtgacacacccagctcctcaggaggctgatgctggaggatcgcttgagcccaagagttcaaggttgcagtgagccatcatcacttcactgcactccagccagggcaacaaagcaagaccctgcctcggggggaaaaaaaaaaaaaaaaaaaaaaaaaaaaaaaaaaa

SEQ ID NO: 5317 - DNA, 872 bp, Homo sapiens
  misc_feature (651)..(651): n equals a,t,g, or c
  misc_feature (750)..(750): n equals a,t,g, or c
tatttaggtgacactatagaaggtacgcctgcaggtaccggtccggaattcccgggtcgacccacgcgtccggcgggggcatcgccgcccgcgcccctctaagtgccgggccgcaagctccaccgcagccgcctgcaagcagcggcgcctcggccctcgacctgcgcgcaaagcctgtgctggagccgtcctcccgcggcggggaccgggaccggggacccaagccaatcgaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctggctggggggcgcccccttgcagggcctcaccctgnccaacaaggcacgcttgccacttttatgagcgctgcatccggggggccacggccgatgcagcccgtacccggragttcctggaaggcttcgtggatganttgctggaagccctgaggagcctctgcaaccgggacaccgacatggaggtggaggacttcattggcgtggacagcatgtacsagaactggcaggtggacaggccactgctgtgccacctttt

SEQ ID NO: 5318 - DNA, 2353 bp, Homo sapiens
  misc_feature (229)..(229): n equals a,t,g, or c
  misc_feature (1759)..(1759): n equals a,t,g, or c
  misc_feature (1908)..(1908): n equals a,t,g, or c
gagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggncctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaarcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcanccccgcctggacctgactggcagcagcgggcacagctccaaccccagccccgagatgagctctaggtccaggtgatgactgcaaagcakkgtccaggagcaggccactactgcccagagagcagaggaggaggttgttggcagggactncagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacmtgttgcccagcacacagtaggccctcaataaaagccatttgcactttaaatataaaaaaaaaaaaaaaaaaaaaaaaata

SEQ ID NO: 5319 - DNA, 2860 bp, Homo sapiens
gcggacgcgtgggtgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagawtagctggctgggagacattctggactggcaggatattgtttcctttgttcacgagaacattgagacatttctttcgatcttggagtctctgtggatcgttatgagccggaatgtgagcctgctgttcaccactgkcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccytctgcccttccagctgtgcctagcaagcaaaacccaggaaagaagcagaagcctcctggccttacatacagaatgcctggacaagagagaacttgctgcgggctgctttgtattttaaaacacagcttgagagttcagmgttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaac

SEQ ID NO: 5320 - DNA, 647 bp, Homo sapiens
  misc_feature (610)..(610): n equals a,t,g, or c
  misc_feature (617)..(617): n equals a,t,g, or c
  misc_feature (638)..(638): n equals a,t,g, or c
gcggacgcgtgggtgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagawtagctggctgggagacattctggactggcaggatattgtttcctttgttcacgagaacattgagacatttctttcgatcttggrgtctctgtggatcgttatgagcctgaatgtgagcctgctgttaccactggcactacactcttgaccattctctttacagnggacagnccttttcaattttgacctctntctgataat

SEQ ID NO: 5321 - DNA, 2229 bp, Homo sapiens
ttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccytctgcccttccagctgtgcctagcaagcaaaacccaggaaagaagcagaagcctcctggccttacatacagaatgcctggacaagagagaacttgctgcgggctgctttgtattttaaaacacagcttgagagttcagmgttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcamwtgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaac

SEQ ID NO: 5322 - DNA, 2780 bp, Homo sapiens
ggcacgagcagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggagctactccctgaactcagcaaactgaagaagaatgactcagggatctactatgtggggatatacagctcatcatccagcagccctccacccaggagtacgtgctgcatgtctacgatcacctgtcaaagcctaaagtcaccatgggtctgcagagcaataagaatggcacctgtgtgaccaatctgacatgctgcatggaacatggggaagaggatgtgattattcctggaaggcctgggcagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgactgcctctcccctctccacaggagactctgcccaggtcctacaccttcttcagctcctagcccccatgggaacagacactgtatggaaactggaggccgctgggtggtcaccaggctgggaggaaggtggcaggtgctccaagacctgggtcgttttcctgagctgacttttctcccttccctgtgcctccacccattctctgaaggtgctgctgatgacccagattcctccatggtcctcctgtgtctcctgttggtgcccctcctgctcagtctctttgtactggggctatttctttggtttctgaagagagagagacaagaagagaacaatcctaaaggaagatccagcaaatacggttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatagaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctacgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacataaaaaaaaaaaaaaaaaa

SEQ ID NO: 5323 - DNA, 1412 bp, Homo sapiens; identical to SEQ ID NO: 3548
  misc_feature (1362)..(1362): n equals a,t,g, or c
  misc_feature (1369)..(1369): n equals a,t,g, or c
  misc_feature (1397)..(1397): n equals a,t,g, or c

SEQ ID NO: 5324 - DNA, 2159 bp, Homo sapiens
  misc_feature (2035)..(2035): n equals a,t,g, or c
  misc_feature (2048)..(2048): n equals a,t,g, or c
  misc_feature (2088)..(2088): n equals a,t,g, or c
  misc_feature (2151)..(2151): n equals a,t,g, or c
gaccctgattacgccaagctcgaaattaacccycactaaagggaacaaargctggagctccaccgcggtggcggccgctctagaactagtggatcccccgggctgcaggaattccccggggcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagaagtattcatccagtgtgcacgaccctaacggtgaatacatgttcatgagagcagtgaacacagccaaaaaatctagactcacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcatawtgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtyaaaayggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaanagcacatatgtgncagggcacaattccctctcataaaaaccacacagcctggnaattgccctggcccttcaaggatagccttctttagaatatgatttggctagaaagattcttanatattgga

SEQ ID NO: 5325 - DNA, 553 bp, Homo sapiens
  misc_feature (30)..(30): n equals a,t,g, or c
gccatgccccagggcttctgaagccagccnaatgtcgatgcaaccaccatttggtaacttttaggtaaaactgggattatgttgtagtttaacattttgtaactgtgtgccttatagtttacaagtgagaccccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaaaaaaaaaaaaaaactcgta

SEQ ID NO: 5326 - DNA, 359 bp, Homo sapiens
  misc_feature (3)..(3): n equals a,t,g, or c
  misc_feature (7)..(7): n equals a,t,g, or c
  misc_feature (15)..(15): n equals a,t,g, or c
  misc_feature (342)..(342): n equals a,t,g, or c
atnggantccccccnggctgcaggaaattccccgggctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccawaaaaaaaaaaaaaaaaanctcgagggggggcccgg

SEQ ID NO: 5327 - DNA, 952 bp, Homo sapiens
  misc_feature (276)..(276): n equals a,t,g, or c
  misc_feature (404)..(404): n equals a,t,g, or c
  misc_feature (724)..(724): n equals a,t,g, or c
gaattccccgggggatcagggcagccggggaggtggccaggccagtggcaggcctgtggagacaatccctyaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggttggcgctgctcccagagcccgtgggtcccaagancttgcgttcccttttgttcctgtcccgtttatcaagaacacgggccccacctgttcacgttgcccgaaggccaccccaagcccaascctgcgggggcgttcccmmaytgccytgraatgcccggcttnaagttyttgcgcaacgcmaggaattcagtgtggggacggcccctgccggattaggcytagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgcntggcacagcccctccccactccgccacgcccccacccaccccgcgtgtttctgccctgtgactcctggaacctgcgtcctccccaaagccatgggaggggtgtcctcctcagaccatgcccccagatgatttttttaaataaagaaacaaatgcacctgcaaaamaaaaaaaaaaaaaaaaaactcgagggggggcccggtacccaattcgccctatagtgagcgatt

SEQ ID NO: 5328 - DNA, 446 bp, Homo sapiens
gccctttcaatcaacaaaaaacarccaaatgcatggggagagactgtaaccaagggacctgccttcaggaactgggatgtgaagggtgtggagaatggatggggtgtgaagggtgagcatgtgaagatgcaggagtccagttttggagatattgcaccaggaggcatgtgggtatcaatgaactacatgaaaggatgtccaagttgttcttaagtagagccaaggttagaaaccttgaatctgtggtgacccgaatcagcactgtttcagacaggatgmctttctcccatgctgactccgggccaagtctatgagamccaccatctgttccaaaaagtaagcagagacttcagacgtgaagccactaaaagacagaagaagtggggacatttttaagacattaaagtcttaagtggggggatgcacagactctggagtgagttggg

SEQ ID NO: 5329 - DNA, 347 bp, Homo sapiens
  misc_feature (218)..(218): n equals a,t,g, or c
  misc_feature (296)..(296): n equals a,t,g, or c
  misc_feature (341)..(341): n equals a,t,g, or c
gggaggaagcgggatgggggttggagaaagggacagaaggcccaggttgaagttccawtcctgttggcacgcagaatcctctggcctttgggagggtggagtggctgtgtcaatcagtctctgagccagtggagggcagggctcgtggtctgtgttttcatcacaggtccccacccctwacacacacacacacgcacacactgtggtgtctagggcanggcttatacagtgaggctccattgactgttaataccacctcttagatctgcgccatagaaatcccctaggtcggccangcgcggttgctcatgcctgtaatcccagcactttaggaggctgangcgagt

SEQ ID NO: 5330 - DNA, 538 bp, Homo sapiens
  misc_feature (537)..(537): n equals a,t,g, or c
gggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttarctgatgggccacagattcttgttggatctagccttggagggtggcttatgcttyatgctgsaaattgcacgaccagagaaggcctggctcttattggng

SEQ ID NO: 5331 - DNA, 2360 bp, Homo sapiens
  misc_feature (2354)..(2355): n equals a,t,g, or c
  misc_feature (2360)..(2360): n equals a,t,g, or c
atgtttaatccattttgatatttgatttaaaatgattctatttytactttctaattttttattgtacatattttgttttatgtttataacctgttctatcttaaagacctaatgttttattttattttatttttagattcttgttggatctagccttggagggtggcttatgcttcatgctgcaattgcacgaccagaraaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattcaaraaaagtttacctttcttatgcttatgttagctatgccagctcttaattgcatccttttctaattaggattattaataaagcgtgaatattttgttttttattatagacagaaatttgtaacattacttctgatttgaaaatgcaattcacaaaatatagggaaatttttattgaagtaaatttgaaatgatggagaaatttcagaagcataataaagttcacaataaggataatactttatataatgtataaagtatatataatataatryatatgkyatataaacygcacattatattcaaacttaaaattgagctttttttttaaaggcccaaaattgtacagtgatacaaggagctatttctaaaatttggcttatgtataatatatttaaatggggaatttcatctaaaacaatgatgtagtatttttaatattctgattggtaaaattaaagaggaaattaatctttatatattatttcttgcagaaacattcattattttattaatattgccctaagtacaactaggcaagtgattgccacctaaatcagaagacgttctaaagtcagtaagaaagtgtgaaatgctagtataaaggttattttttttctttcctaaataactaaagtgaggtgtagattgagccttgatattatttagttaatgttttttattaattaattttggctggactttatttagcttgattaggttattatctgtcaaaccttttaagttgacaacatgactcatatatatacatgtgtataagatgagcatgtgtcgaagcttattcgactcattaatgaggaaaccagcagatagtaaacctggttcaaagtacaattcaagaaactgagtatttatgggcattgaagaaaaaatgttgagataaaattgctgtgcagaaaaaagtgttaatgaagccgacctgactacttaaccttagagacctgctttacaaggttggcccttgattggcatctgggaacttggagttcagggggcttccaccattcccagaactgatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaactgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaannggggn

SEQ ID NO: 5332 - DNA, 3032 bp, Homo sapiens
  misc_feature (451)..(451): n equals a,t,g, or c
  misc_feature (1920)..(1920): n equals a,t,g, or c
  misc_feature (2977)..(2977): n equals a,t,g, or c
  misc_feature (2991)..(2991): n equals a,t,g, or c
  misc_feature (3007)..(3007): n equals a,t,g, or c
  misc_feature (3032)..(3032): n equals a,t,g, or c
gaattcggcacgagctcaggtaaccttaattctaactacctactaaccatttggatgctggagggagtggataggcccagagcaggaaagtggaaaggggtaaaactaatatgtacaaaatcacttatagagtatgttttctttgccagcccttaatggtagggcttggctgtataggttctattgctattgttctactgttgttattattagttccacatgtttgtccgaagattctataatatttttgtttcccaagtagaaagcaataggttaaattttaaaagttgtttgttttttcatcttcaagttgtcttttcccattccccgcgttgcatgtgagaaagcagtctctcggagggcgcttacatggggactcctacaaggaatattgtgtttccactatcactttaccctcagcactgttgcaggaatagctgcacgtacattncattctcatgcaagccatttatcatgttccccaccaatactgctgtttcctaactaggcttagacttacacaacccacagctcttagatctattatgtctattgtgttaaattaaacttttataatgtacatcagtttctgtcctaacacccagatatcaccwttattttgttctttctgaaaacatataattattagatatgcagtttatacattttatcaaagactggttttatgtgcaattgktaaaatgattgctttctttcctagattagcaagtattatatgccactatataatacatgttcacatgtgcctatagatataggtgcacatgtatagacacatgtctatatcctattaagcctagagatatttttttgtgtgacccatttctccattttctattgttctccaggacaaaggcaagactcaaaaatagtatatgatttacctctactattgctctgtgcacaatcattgaaatatgtatgtataattttkggcatgaaaaagcaatctttcgaaaatgacaataagaaatgtctgttgatcccttgcactaatgaacaatagaaaatattaacagcacttgcagtactagttgattatggcattggctaactcggtttatgtggattctaatgaaacatttgggagaaatggaacaaaatatctccctgagcttaagtgatatactcaaaatgcctgcatgttgtaaggatttttcaaatgctgaaatatatttcattacagccaaacatcagcaggatccccagggkttggatcatttgaaaatactgtgttcgaaagggcaccttaataacattgkaaagctggaaggaaagargggatatgaacmatagacactttttttaatctcggggaaaaaaaatccatctcacgttagacttgtttttatattggctttccctcttccctctttctctctcacacaataaaatgcctttgaaatgctgacacataaataatttcctacctaaacatctcagagcctgattccatcaaaaagaaaggagtaaaaagcaagttacagcccagcagcacatctgctttccctgggtccgggggctgccaggagggagcgggaggtctgtccacctcacaaggcaggctctgtcagcttttgtcactccctgatttcttattctttgttaccttttttcgcctgactgatttttacttggcatttaagttccccttagcactgccagattctaaaaggttatattctttttaaaaaagaagagaaagaaagaaggaaagaagacaaagaaagaataaaaacctccgagtgttaactactttttcctttcttcttttttttataaagaatacattctttcacatcttgaatttctgtgaattttagtttccattctttctccttkcaaaccagacacctaaattatacgtcgaagmtgttaaaaagttgttttttttttttnaatggaaaatatccaagaagcagcccaggagtatctgacatggtggaatggaatcagttagaaagcgaagaaatcactaaaaaaagttacttctttttttccccaccagttataatcttcaaccttactagtttataacagtttaatgtcctatagaaggatcctccactaaagttataattttaagtatagtcatatagagagatccctaatcccctgggtaatctagatactaaaggtggggaagaacagtcatattgacattctttaatccaaaaccactgtttgaaattagtaaggatattttcagcattcccaaaaacatgttattagcacgttgagctgaaaacgtttttcttcctcagtgagtacagaaaccaaagcagtctgcgtgtatgtctatgtatagactgtatcgtacctgggctcatggagtagtctaaatttaaaacgtcctctcttctacctccaatgaaaatgtttccgtgtgtggcgtctgatcttccaccgtgtgtgtggtcgtctgctggtgtagcgctgtttaaggagcgctgtgtgctgctagtgttccacgatgtgtgtggtcgtctgctggtgtagtagcactgtttgaggagcactgtgcgccgctagtgtgggtttacacttatgagtgttgtcattacatgtgttctgctcttctctccctctcctgcccctgccctgctccatcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtatgctgagactcaattactctcttattagcttccccgtttggaagatcccaaacaccaaagatggaaggtgaaaataaagactgcgtgaccgggaagaaagtttgaattactaatagtggggaataataatttcagttttggttttaacattctggaattcctaaaaaaaaaaaanaaaaaaaaaaaacncgggggggggcccggnacccaattccccccaaagggggggn

SEQ ID NO: 5333 - DNA, 957 bp, Homo sapiens
gcatttctgctcctgatctgccctgtcgatttctaaccatcagggctttttcatgttattactgatgcttgtraacacgtctgctgtagcctgcactcacggaggcagagggccgtgggggaactctgcagcccaagcttgcgccgcgctcgcccgtggcccaggcaggacccttccgcggcctcccagtggcagccacaggtgctggttggtttgctgarctatcacgggtggggtgggcagcgtctgagtccttgcccgagaagcatctgctgtgtgtccacgaggcacctggagggggccagatccaaggcacagggccctgctgcatggctccacatggaagttcgagtcccccgtgtccagccgccggccctgcaggtgcccagcagctctgacaaagcggggcagggccgctggggtgtccctggacagcggggcctggtgggcaggggaggaggctgcaaggtgacacccagtttgccttgcagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcggtgagcccgcaggagtggggtcgtcctcgcgacccttgggcgggggctgggcagagtgtggggcgagtctccgtgggagcccaggacaggagtggagtccccgccatgcctccattcaccaggctgccctgtgtaacaaagaaacccctgagaaggaaggttctggagacctggcagggttcgtagggagctttccaatctgatttgttttggcgatttatacaaccaaactccaagcccagttccgaagctctgagccttccatggcctcaggctgggattcaggtgcctggaggtgggggatacccgcacccagccctcgag

SEQ ID NO: 5334 - DNA, 1705 bp, Homo sapiens
  misc_feature (1664)..(1664): n equals a,t,g, or c
  misc_feature (1687)..(1687): n equals a,t,g, or c
ggcttcctcggktactcggmcactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggcmaggaagaagcctcagctcagccccggaacttytcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcrctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccgggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatytcggagccagcctggaagcctccagcagggctattcccccacamccytacccaytggaaaggagtgttktaagaytaggttttggytaaggaanttccagcgggggtttcaagtttncccaaggcaattttcaag

SEQ ID NO: 5335 - DNA, 1255 bp, Homo sapiens
  misc_feature (541)..(542): n equals a,t,g, or c
  misc_feature (1156)..(1156): n equals a,t,g, or c
  misc_feature (1162)..(1162): n equals a,t,g, or c
  misc_feature (1223)..(1223): n equals a,t,g, or c
gaattcggcacgagcacatttaataatctaattcacacacacacacacacgtgaaatcattcttgagaatgaaatttatcatgcttttacttcttccttcaatcttcccaactactgttgaaatgatctgagattttagatctacattattgttactttttaacattatgtatcttctgtttcaagaaggcttttgatgtttgagttaagtttcataagcttttaaacaagcatttagacatttacacctgcttaactgatttcattgatcacttttatttcatttgcactgtatatccccattatttcaactcatttcacagttgtctttggtacttcttttagtacttttttaaggaacagatgggtgatacagtattatatgttcttgccttcctgaagatacttgtgttcaatagagcgtaacatttttttcccacagtgacttttccctcagaatactaaagtcacagaaagttatcacatcaacttaatgttgcccaagagaagtccaaactctttgcgcttcttttgtaggttnntttgggttatctccccacaatgatgtttatagattctttattctttcttcttggaacaaagaaatttcattgggatatgtttttaaaaatagatctctttttattatttttgcatggtactagatgagacattttagtgcatagatgcaagtcttttttcaactctgggaattttacttctatggaatttttttttctttccctaatattttttcactctttttcttatcctttagaaatttttatgttgatcccctagatctgctctctgttctgactagtttttgctcattatatctttttatccttttcccttagaatcagtacttcttgaaataaactgcttctatgattctgaggtatagccaaattggggaagccctcttgtgaagggtcagcagtgtttacctggaagaagaacccatttcagttgtgcttcttgctgtttggctgcctgattcaatcagtggcagaaaatcatattaaatatatttagagtactccctttaaaagrattacctctctttgaaattcagtaaatttacattgagratatttgacaaatttgtatatacatttgcaggcaataatttttatgagctgatctgccatgnttaaangttttcctttgtaaaccatttggtgtgggtattttttaaatttcctcagtatgatcccagngggcattaactgtccaaaaaaaaaaaaaaaaa

SEQ ID NO: 5336 - DNA, 1699 bp, Homo sapiens
ggcacgagggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcctggctactaatgaggatagtagcttattggccaaggacagccccccgacacctaccatgtacaagtatcggccgggttacagtagcagcagtacgtcagctgccatgccgcattcctccagcgccaaggtactgagtactctaagaggtggggtaataacatgccaactggccaggcacagtggctcattcctgtaatcccagcactttgggagcccaaggtgggtggatcacaaggtcaagagattgagaccgtcctggccaacatggtgaaaccccgtctctactaaaaatacaaaaattaggccaggcgtggtggctcacgcctgtaatcccagcactttgggaggccgagactggtggatcacaaggtcaggagttcgagaccagcctggctaatgtggtgaaaccccatctctactaaaaatacaaaaattgccgggcacagtggctcacgcctgtaatcccagcactttgggaggctgaggcaggtgaatcacgaggtcaggagattgagaccatcctggctaacatggtgaaaccccgtctctactaaaaatacaaaaaaattagccaggcatggtggcaggtgcctgtagtcccagctactcgggaggctgagccaggagaatggcgtgaacccaggaagcggagcttgcagttagccgagatcatgccactgcactccagcctgggcagcagagcgagaccgcatctcaaaaaaaaaataaataaataaatacaaaaattatctgggcgtggtgggggggcacctgtaatcccagctattcgggaggctgaggcaggagaatcacttgaatctgggaggtggaggtggcagtgagtcgagattgcgccactgcactccagtctgggtgacagagtgagagtccatctcaaaaaaaaaaaaaaaaaattagctggtagtggtatgcatctgtagtcccagctacttggcaggctgaggcaaggagaatcgcttgaacctgggaggagaattgcttgaacctgggaggtggaggctgcagtgagctgagctcccactgctgtattccagtctggtgacagagtgagactacacctcaaaaaaaaaaaaaaaaaaaac

SEQ ID NO: 5337 - DNA, 718 bp, Homo sapiens
  misc_feature (55)..(55): n equals a,t,g, or c
  misc_feature (57)..(57): n equals a,t,g, or c
  misc_feature (656)..(657): n equals a,t,g, or c
  misc_feature (711)..(711): n equals a,t,g, or c
ctaagcctgtatgtgtcacctgcagtgcccatatacaatggaattatgtttctcntngtgttggccaacttsgagcatggccaccttcatggacccagggattttccctcgagctgaggaggatgaggacaaggaagatgrtttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgycagccgtgttctctgcagttctccagcacccaggtatttggggagaccanngaaagagaagacaattgtaatcagacctcccttccttcgaccaagaagtttcanatgggca

SEQ ID NO: 5338 - DNA, 2063 bp, Homo sapiens
ggcacgagctcgtgccgctcgtgccgctcgtgccgcgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccaacccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatc

SEQ ID NO: 5339 - DNA, 3665 bp, Homo sapiens
  misc_feature (4)..(4): n equals a,t,g, or c
  misc_feature (16)..(16): n equals a,t,g, or c
  misc_feature (29)..(29): n equals a,t,g, or c
ctcnccactaattggnacaaaagccgganctccaccgcggtggcggccgctctagaactagtggatcccccgggctgcaggaattcggcacgagctcgtgccgctcgtgccgctcgtgccgcgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccaacccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgtgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggcagcatcgagcctgagctgccatgcagctggtgtcccaggacgatgagagtggccaaaagaagctgcacggtttgcaggccattttggtcacgaggcatcaggaaccacmgcatcactgccactgccactggctaccaggagtcccacctcagctctgycagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttccccttcatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaagtgctgctgctaagggcctgtctcttatacacatctcaacctgcagg

SEQ ID NO: 5340 - DNA, 3599 bp, Homo sapiens; identical to SEQ ID NO: 3887
  misc_feature (2675)..(2675): n equals a,t,g, or c

SEQ ID NO: 5341 - DNA, 1885 bp, Homo sapiens
  misc_feature (42)..(42): n equals a,t,g, or c
  misc_feature (543)..(543): n equals a,t,g, or c
atgccargaagactgatggagcaggcttgcaatattaaagtnccaaccaagaagctgaagaaatwtgagaaagaatatccagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacagtagtggtgtttgttgcaacatttatttccacaaatgaatttatgaacaacagtgatatttgacttaaagtatgaagtttcagaatcaaaataatttcattttaatacgttcngttaattgtgaatctcttcmatggtaattagcaacactgttcccaggatgcaaagttgggaaacacttatttccaacttatttttttccaagtaaaatattatctctcttcaacatgctttaacttttcagactcacacagatacgtwacagctcccttctccctccatatcaatacactaagataaaagaatactgtattttcagcactgagcagcagtgccaaaatctcctgccaagaaatggactgtgtggcattattaattaaatcacccacattgggatgacttccacttttgtaactagagttatctttatgtggtcagagctggacataggcagcatagtcacacagaacatcttatctctgtkgckgaatkgaatagcatgggatgtgtgcagaggaacatggkgggagtatgtaggtttkgtagtcagacagacckgaactcaaatcttgytcattttttagagcacaggatttggaytccaaattgagggttttaatccccatgccaccattcagcatcttcgactagttattgaacctyttcctcatskataaaagatatagtgtttctgattccttgatggattgttacaaggatgagggatgctgtatgttaaggactcagctcatagttgtgttcaataaatggctgttattttatgaagcctactactacagattatgcaattattactagaataatgccaccttatgtgggtcttcccctctagtcccttattgattgttcttatttctctcaagtattgccaaccaataatctccccttgcttatagaagtggttcaagatctgattataaaatcccacatacttctatagcagataactattaacagataatgtttgractaatttcaccaccaacattccccctcaataaaaccagcttttaatgtaaatcacatagcatactgctttagaaaggcttgaaggtagtaattataaactattattaagcatccaaaatgaaggtctccttttgctaatatcattcagattttcttattactacaattattatgaataaattctgtgaagagtgctttaaaataagagagaaatggragaccaaacttgtacatttaaaatcaggctggaattgaacttgttattgtgtcttaaatccttttttgtgccaaagcaggtatgtatacattaatagtaagatgtacattatttttaaagtacttatmacatgtaagattatcaatatgtatagtttttattgagagatcaaagtaggattaaacttcttgttttgaaagcaggcattactttttaaaaaaaaaaaaaaaaaaaaaaaaaaaaaaaaa

SEQ ID NO: 5342 - DNA, 1707 bp, Homo sapiens
  misc_feature (1)..(1): n equals a,t,g, or c
  misc_feature (1625)..(1626): n equals a,t,g, or c
  misc_feature (1628)..(1628): n equals a,t,g, or c
  misc_feature (1631)..(1631): n equals a,t,g, or c
  misc_feature (1640)..(1640): n equals a,t,g, or c
  misc_feature (1688)..(1688): n equals a,t,g, or c
ntaaaagctggagctccaccgcggtggcggccgctctagaactagtggatcccccgggctgcaggaattcggcacgagaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagctttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgttaaaaaaaaaaaaannanaanaaaaaaaanaaaaaaaaaactcgaggggggggcccggtacccaattcgccctatagngagtcgtattacgcgcgct

SEQ ID NO: 5343 - DNA, 1486 bp, Homo sapiens
cggcacgagccagggctgaggtaggagggagtctgtccctcgacgcctcctgcgacgccagcccctgagcgatgatgcgaacgtgcgtcttactctccgcggtgctctggtgcctcacaggagtccaatgcccgcgttttaccttattcaataagaagggcttcatttatggcaagacaggacagccagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatattctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgtgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgatcttcacatcccagagcatcatagatagttccattaagtaaaatcagtaagaccaaaccactgggaaaacatgcattttggaaactttaaaataaaatgggttaacatggcatttctaagaaggcatttaatccggtatctctagtgtacaaaggaaacttgaagttttcatggattatttttaatgaaatgttttattgtttacaaacggtatgttgctgtgtacctaagggtttagtaaggtcaagaagggtttcaaagtttaataaaataaaaattgtatactctccaaaaaaaaaaaaaaaaaaaaaaaaaaaaaaaaaaaaaaaaaaaaaaaaaaaaaaaaaaaa

SEQ ID NO: 5344 - DNA, 398 bp, Homo sapiens
cccccctggcccccccattaatgccatggtttgggaggagcckgatcccctgaaccccatatttaacctctactgcccmsggaaatgccctacattatttttccctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagmtwtgggggtctttttagattttaatccctactttctttatggtacaaatatgtacaaaagaaaaaggtcttatattcttttacacaaatttataaataaattttgaactccttctgtttaaaaaaaaaaaaaaaaaaaaaaaaa

SEQ ID NO: 5345 - DNA, 822 bp, Homo sapiens
ggcacgaggttccctctccccagagccatcggccaggtaccaaagctcagctgtatggattcccaacaggaggacctgcgcttccctgggatgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggtgcagagtaggaaatggaactaacctcaggaaggtggtattgacagaagtcaggacccacctggatgtcatgctatgaaacatttgaagcaaaaaaaaaaaaaaaaaaaa

SEQ ID NO: 5346 - DNA, 783 bp, Homo sapiens
ggcacgcggaaaggctggcctctcttcamcatgggmtcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagatgtatgcgaaatgccaaaagaaactggcccctgcctggcttattttcttcattggtggtatgacaagaaagataatacttgctccatgtttgtctatggtggctgccaggggaaacaataacaacttccaatccaaagccaactgcctgaacacctgcaagaataaacgctttccctgattggataaggatgcactggaagaactgccagaatgtggctcatgctctgagtactgttcctgtacctgactgatgctccagactggcttccagtttcactctcagcattccaagatcttagcccttcccagaacagaacgcttgcatctacctcctcttcctccatctttggctcttttgatgcacaatatccatccgttttgatttcatctttatgtcccctttatctccaacttctagaactcccagtttatacctgtgtcactctcaattttttccagtaaagtacttgatgtwgaaaaaaaaaaaaaaaaaaaaaaaccggcacgagggggggcccggtacccaat

SEQ ID NO: 5347 - DNA, 944 bp, Homo sapiens
ggcacgagttggagaaggtcccggacctcatcagccaggtgttggccacctaccctgcagatggggaaatggcggaagccagctgcggagtcttctggctgctgtccctgctgtgctgcatcaaggagcagcagtttgaacaagtggtggcgctgctcctgcaaagcatccggctgtgccaggacagagccctgctggtgaacaatgcctaccagggactggccagcctggtgaaggtgtcagagctggcggccttcaaggtggtggtgcaggaggagggcggcagtggcctcagcctcatcaaggagacctaccagctccacagggacgacccggaggtggtggagaacgtgggcatgctgctggtccacctggcttcctatgaggagatcctgccggagctggtgtccagtagtatgaaggccctgctccaggagatcaaggagcgcttcacctccagcctggaactggtttcttgcgtggaaaaagtgctcttgaggctggaggcagccacctctcccagccccctgggtggggaagcagctcagccctgatgtgggggagaagacagataccccacaggcccctccctccacgtgtgccctctccctgtccttcctttccatgggccactgtttcccttggggtggggggaagggtcatccagcaccagaatgcgcacctcacactcctcttaggtgactaataaagaggcccaaggccagtttctgccttaatcatttctggcaagaggctgtgactggccagtgggatacttaattctgccgtctctatagacctcgcccctggacagagcagtccttccagaccattctagatgagagtcaacactgagcctccacaggctccattccaagtaaacatctgcatttattttaaaaaaaaaaaaaaaaaaaaaaaaaaaaaaaaaaaaaaaaaaaaaa

SEQ ID NO: 5348 - DNA, 460 bp, Homo sapiens
  misc_feature (178)..(178): n equals a,t,g, or c
  misc_feature (393)..(393): n equals a,t,g, or c
  misc_feature (418)..(418): n equals a,t,g, or c
  misc_feature (440)..(440): n equals a,t,g, or c
aattcggcacgagttggagaaggtcccggacctcatcagccaggtgttggccacctaccctgcagatggggaaatkgcggaakcakctgcggagtcttctggctgctgtccctgctgtgctgcatcaaggagcagcagtttgaacaagtggtggcgctgctcctgcaaagcatccggntgtgccaggacagagccctgctggtgaacaatgcctaccagggactggccagcctggtgaaggtgtcagagctggcggccttcaaggtggtggtgcaggaggagggcggcagtggcctcagcctcatcaaggagacctaccagytccacaggggacggacccggaggtggtgggagaacgtgggcatgttgctggttccacctgggttcctattnaggagatcctgccggagctggtgtncagtagtatgaaggccctgttncaagagttcaaggagcgttt

SEQ ID NO: 5349 - DNA, 777 bp, Homo sapiens; identical to SEQ ID NO: 4297
  misc_feature (708)..(708): n equals a,t,g, or c

SEQ ID NO: 5350 - DNA, 878 bp, Homo sapiens
  misc_feature (21)..(21): n equals a,t,g, or c
  misc_feature (25)..(25): n equals a,t,g, or c
  misc_feature (116)..(116): n equals a,t,g, or c
  misc_feature (132)..(132): n equals a,t,g, or c
  misc_feature (876)..(876): n equals a,t,g, or c
gctccgtcaggggggccggancctntggaaaaacgccggcaacgcggcctttttacggttcctggctttttgctggcctttggctcacatgttctttcctgcgttatcccctgatnctgtggataccgtatnccgcctttgagtgagctgttccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaasagctatgaccatgattacgccaagctcgaaattaaccctcacwaaagggaacaaaagctggagctccaccgcggtggcggccgctctagaactagtggatcccccgggctgcaggaattcggcacgagacaatcaattcattttacttaattggcatatattgaaccacgacagccagcaactggggaacatttttttttaagtatacagaacattaaaaaaaactgacaatcaactatgtaaattttttttgacacatttaataaaatctatatcataaactggtatttttgggctacaagtcaattaggttaagaaataaaaataagttaaaaacaacatatttagtaaaatttttttcttaataatttatgggttaaagatgaaattgtaattgaaactagaaaataaaaaactcgagggggggcccggtacccaattcgccctattagtgngt

SEQ ID NO: 5351 - DNA, 694 bp, Homo sapiens
  misc_feature (621)..(621): n equals a,t,g, or c
  misc_feature (651)..(651): n equals a,t,g, or c
ataactggagagacatcaaactcatgctgagaacaactagaagagttagaattgaagaaaaaggatttcattaagatattagagagtgttcaaggcaactggaggcagaacgargattctggaaaggggccacagagaagttgtctgcattcaaaagagcattctattaaagctaccttaatttggcgcttatttttcttaatcatgtttctgacaatcatagtgtgtggaatggttgctgctttaagygcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagmttccaggaactgktaagaaaatagttctggccagaatcaaagattcagccctacaaggatatgttttcctgtgaaattatctaagagaatttcctgttgagatataaaggcccatctgatcactggattgggctgascaragaacaaggccaaccatggaaatggataaatggtactgaatggacaagacagtaagtnctaaaaatctggcagtaatatttgtatttnaatttactttgcattaaatctgaagtgttctctagttacatgc

SEQ ID NO: 5352 - DNA, 1048 bp, Homo sapiens
  misc_feature (79)..(79): n equals a,t,g, or c
  misc_feature (117)..(117): n equals a,t,g, or c
  misc_feature (138)..(138): n equals a,t,g, or c
  misc_feature (144)..(144): n equals a,t,g, or c
  misc_feature (147)..(147): n equals a,t,g, or c
  misc_feature (625)..(625): n equals a,t,g, or c
ggcacgagagaaagtgggcccttaccaggcaccaaatctgccagcactctgatcttggacttccagcctcctgaactgntgtctgcattcaaaagaacattctattaaagctacctnaatttggcgcttatttttctnaatcangtntctgacaatcatattgtgtggaatggttgctgctttaagtgcaataagagctaactgccatcaagagccatcagtatgttcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatagttctggccagaatcaaagattcagccctacaaggatatgttttcctgtgaaattatctaagagaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaanactgtcatgggtcttactctgttacccaggctggagtgcagtarttaccatcgtggctcactgcagccttgacttccctggctccaagtgagcctcccatctcaggctcctgagtagctgggactacaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaataaaaaaaaaaaaaaaaaaa

SEQ ID NO: 5353 - DNA, 1530 bp, Homo sapiens
  misc_feature (1389)..(1389): n equals a,t,g, or c
  misc_feature (1488)..(1488): n equals a,t,g, or c
ggtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgcttggtgcttctgggatgttccactaatatacagctatawcyaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaatgcgcatgttctgatgtttttatgatgtgaggatttattgaaaactcaagttcgatactctcagtacatgaaaaaaaanaagaagaaaaaaaaaaagtttttgccgggtcctttggttcttcctgggtctgggctcgcctagggacctcgggatggccgcctatcgagggctcgcggnggcggtccggtgtttgcccagggtccaaggtctgtccgcttg

SEQ ID NO: 5354 - DNA, 100 bp, Homo sapiens
  misc_feature (21)..(21): n equals a,t,g, or c
agccttggcattgagaatgcntgaggaagccaacacctcgtgccgaattcctgcagcccgggggatccactagttctagagcggccgccaccgcggtggc

SEQ ID NO: 5355 - DNA, 988 bp, Homo sapiens
cggcacgagccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccagggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcataaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcagcccctggcctgatccttctctctgtgctgatggtccaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgaaaaaaaaaaaaaaaaaacggcacga

SEQ ID NO: 5356 - DNA, 619 bp, Homo sapiens
ggcacgagctggggcctgtgtgcctccacgccataatgctggcagaactgatatttctctttaggagtctccatgggatacttgcctccgcaggcaccataggagcagtggcagcttggctgatgagctataagccagccttgtttgggttcctattccttctgctgttgcttagcaactggttggtcaagtatgaacacaagctcaccctcccagagccccagcaggaggaagagaaaccaaagacttctgaaaacgactccaagaacagcaaggccgtgaacacaaaagaagtcaatagaacgcatgcctgctttgccctccaggacgagatcctccaacggctgttgttcagtgaaatgaagatgaaggtcctagaaaatcagatgttcatcatatggaataaaatgaatcaccacgggcggtcaagcagacatcggaattttcccatgaaaaaacacagaatgaggaggcatgagtcaatttgccccaccctgtctgactgtacttcgagttcccccagctaatgaggycgaggcgggctggcctctgccgatgttaccttttacctcagtaaaacccagtcacagcctaaaaaaaaaaaaaaaaaaaactcgta

SEQ ID NO: 5357 - DNA, 752 bp, Homo sapiens
gaattcggcacgaggaaaaacccaaggaaccagatagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctamactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagcckcctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaaaaaaaaaaaaaaaaaactcga

SEQ ID NO: 5358 - DNA, 967 bp, Homo sapiens
  misc_feature (656)..(656): n equals a,t,g, or c
  misc_feature (754)..(754): n equals a,t,g, or c
cccgtccccttccctcccccctgccctaagccacctccacctctgtcctggacacctcagggcgccctgaaaggaccaggacatgcggctgcgcttttggctcctcatttggctcctgctgggatttatcagccatcagcccacccctgtgtctttcctgaagactatcttctggtctcgaaatggacatgatagatccagggatgtacagcagagagctaggaggtccaaccgcwgtagacagraaggaattaaaattggcctggaagacatctgtactttatggaaacaggcggaaacaaaagttcaagctaaaatccgtaagatgaaggtcacaaagaaartcaaccatcatkacaaaatcaatggaaagaggaagaccgccaaaaacagaaaatgtttcaacgtgcgcaagagttgcggcggcgggcagaggactacyacaratgcaaaatcaccccytctgcaagaaagcctctttgcaacygggtcagaatggcggcagyggagcatgcrtcattcttcaggattgccctrctggccctacctcacagctgaaactttaaaaaacaggatgggccrccagccacctcctccaactcaacaacattctataactgataactccctgagcctcaagacacctcccgartgtntccttcatccccttccaccctcagtggatgataatatcaaggagtgtcctcttgctcctyttccaccctcagtggatgataatctgaaggagtgtctncctggtccctcttccaccctctcctyttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccta

SEQ ID NO: 5359 - DNA, 542 bp, Homo sapiens
  misc_feature (389)..(389): n equals a,t,g, or c
agggcacgagtttttttatgactacataatgtttattgcgatctattttaaggcttttcatggatcttttcagctatgcacatggttagtcataatgattgtcattttaggtcagagtttctcagccttagcattgttgacattttggttaattctttgttgtaggggctgtcctgtacactgtagggtgtttagcagcatccctgatctctacctactaaatgccaggagcaacacagtacctccagctcagttgtgacaactactgaatgtctccagacaactactgaatgtctccagacattgcagagaaattgagtctggttgagaagtcactgttttagggcataatttttgggtagactgttagattctttgtgttcgttgtntctggcctgtataactcttcttaattatctgctactcaaatgtatttgggatcagccactgtcttccatttctcttttgctcacagatctactccacagctcttctcccttcaaacactgttcctcagcatcttgttttttgcagccaaacat

SEQ ID NO: 5360 - DNA, 1043 bp, Homo sapiens
ctgaagtgtatgtggtgaggaagaagaggctcctactgtagacagccttgttctacagatcctcccagaaatctctgggccaggtggaacccagggtcagagagggatgggagagaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggargacttggatgggtttgagggttactccctgagtgactggctgtgcctggcttttgtggaaagcaagttcaacatatcaaagatwaatgaaaatgcagatggaagctttgactatggsctcttccagatcaacagccactactggtgcaacrattataagagttactcggaaaacctttgccacgtagactgtcaagatctgctgaatcccaaccttcttgcaggcatccactgcgcaaaaaggattgtgtccggagcacgggggatgaacaactgggttagaatggaagkttgcactgttcaggccggccactcttctactggctgacaggatgccgcctgagatkaaacarggtgcgggtgcaccgtggartcattccaagactcctgtcctcactcarggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaaaaaaaaaaaaaaaaactcga

SEQ ID NO: 5361 - DNA, 985 bp, Homo sapiens
gctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaatccmaaaaaaaaaaaaaaaagtcgacgcggccggcaattta

SEQ ID NO: 5362 - DNA, 247 bp, Homo sapiens
  misc_feature (204)..(204): n equals a,t,g, or c
  misc_feature (244)..(244): n equals a,t,g, or c
gcawcttagatccggccccggtccccgtccccttccctcccccctgccctaagccacctccacctctgtcctggccgcctcagggcgccctgaaaggaccaggacatgcggctgcgcttttggctcctcatttggctcctgctgggatttatcagccatcagcccacccctgtcatcaatagtctggctgtctatcgtcatcgngagactgactttggtgtaagagttcgagaccacccctggncaa

SEQ ID NO: 5363 - DNA, 1308 bp, Homo sapiens
  misc_feature (1269)..(1269): n equals a,t,g, or c
  misc_feature (1281)..(1281): n equals a,t,g, or c
actcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaacygccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaacygggtcagaatggcggcagyggagcatcgtcattcttcaggattgccctrctggccctacctcacagctgaaactttaaaaaacaggatgggccrccagccacctcctccaactcaacaacattctataaytgataactccctgagcctcaagacacctcccgartgtctccttcatccccttccaccctcagtggatgataatatcaaggagtgtcctcttgctcctcttccaccctcagtggatgataatctgaaggagtgtctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgakaacacgccattgcacttragtgcaatangaataaatccgnggcccgaaaaaagaaaaaaatctaaac

SEQ ID NO: 5364 - DNA, 1248 bp, Homo sapiens
ggcagtgcacacccccatggcccgggctttggtccagctctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggtctgcaaaccactcagaatggccgattctatgccatctctgcacgcttcaaaccgttcagcaataaagggaaaactctggttattcagtacacagtaaaacatgagcagaagatggactgtggagggggctacattaaggtctttcctgcagacattgaccagaagaacctgaatggaaaatcgcaatactatattatgtttggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaatcgaaggattgggaacagactaaagacaacaaagcccaggactgggagaagcattttctggacgccagcaccagcaagcagagcgactggaacggtgacctggatggggactggccagcgccgatgctccagaagcccccgtaccaggatggcctgaaaccagaaggtattcataaagacgtctggctccaccgtaagatgaagaataccgactatttgacgcagtatgacctctcagaatttgagaacattggtgccattggcctggagctttggcaggtgagatctggaaccatttttgataactttctgatcacagatgatgaagagtatgcagataattttggcaaggccacctggggcgaaaccaagggtccagaaagggagatggatgccatacaggccaaggaggaaatgaagaaggcccgcgaggaagaggaggaagagctgctgtcgggaaaaattaacaggcacgaacattacttcaatcaatttcacagaaggaatgaactttagtgatccccattggatataaggatgactggtaaaatctcattgctactttaaaaaaaaaaaaaaaaaaaaaactcgag

SEQ ID NO: 5365 - DNA, 1546 bp, Homo sapiens
ggcacgagttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaaaaaaaaaaaaaaaaaaaa

SEQ ID NO: 5366 - DNA, 1643 bp, Homo sapiens
  misc_feature (5)..(5): n equals a,t,g, or c
  misc_feature (59)..(59): n equals a,t,g, or c
aaganagaaattaaccctcactaaagggaacaaaagctggagctccaccgcggtggcgnccgctctagaactagtggatcccccgggctgcaggaattcggcacgaggccctgatggcagttacgtggcrgcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctggcttcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctcttccactgttcttcagagctttctggctctctttccccacaaaattcgacacatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggcggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaaaaaaaaaaaaaaaaaactcgag

SEQ ID NO: 5367 - DNA, 866 bp, Homo sapiens
  misc_feature (833)..(833): n equals a,t,g, or c
gaatacgccagctctaatacgactcactatagggaaagctggtacgcctgcaggtaccggtccggaattcccgggctcttgatctttcctggtcctggtacggggatgacctctcttttagaggggcgaatggttctctgtgtctcctgcctcctccttcccctgctgttgttgctgaaacactttaatgggttgatgacaccatatttagctcataatgtatattgtcctatagaatatatttcttttttcccatttcatgaaaaaaatatagaatatatttctatttggttcatctttgacagttttaagtttatctattcgaggcttttgtgtatttcccaaatttatgtgctttatagagcatatactttgccccattagatgcagtggtattgcaatagttatcctcagggaggtaggctgtgtgtgtgtgtgggtgtgagtgtatgtatttgtataaaagaaaatccaatattacatgcatttggccgggcacggtggctcacatttgtaatctcagtgctttgggaggctgaggtggacaggtcatttgaggtcaggagttcgagaccagcctggccaacatggtgaaactctgtctctactaaaaattaaaaaattagccaggcgtggtggtgtacatctgtaatcccagctacctgggaggctgaggcaggagaatctcttgaacctgggaggtggaagctgcagtgagccaagattgcaccactgcactccaggctgggggacagagcaagactccggtctcttcaaaaaaaaaaaaaaaaaaamaaamaaraaaaaaagggcggccgctctagaggatccangcttacgtacgcgtgcatgcgacgtcatactct

SEQ ID NO: 5368 - DNA, 732 bp, Homo sapiens
cttgatctttcctggtcctggtacggggatgacctctcttttagaggggcgaatggttctctgtgtctcctgcctcctccttcccctgctgttgttgctgaaacactttaatgggttgatgacaccatatttagctcataatgtatattgtcctatagaatatatttcttttttcccatttcatgaaaaaaatatagaatatatttctatttggttcatctttgacagttttaagtttatctattcgaggcttttgtgtatttcccaaatttatgtgctttatagagcatatactttgccccattagatgcagtggtattgcaatagttatcctcagggaggtaggctgtgtgtgtgtgtgggtgtgagtgtatgtatttgtataaaagaaaatccaatattacatgcatttggccgggcacggtggctcacatttgtaatctcagtgctttgggaggctgaggtggacaggtcatttgaggtcaggagttcgagaccagcctggccaacatggtgaaactctgtctctactaaaaattaaaaaattagccaggcgtggtggtgtacatctgtaatcccagctacctgggaggctgaggcaggagaatctcttgaacctgggaggtggaagctgcagtgagccaagattgcaccactgcactccaggctgggggacagagcaagactccggtctcttcaaaaaaaaaaaaaaaaaaaaaaaaaaaaaaaaaa

SEQ ID NO: 5369 - DNA, 830 bp, Homo sapiens
  misc_feature (710)..(710): n equals a,t,g, or c
  misc_feature (742)..(742): n equals a,t,g, or c
  misc_feature (749)..(749): n equals a,t,g, or c
  misc_feature (757)..(757): n equals a,t,g, or c
  misc_feature (806)..(806): n equals a,t,g, or c
  misc_feature (817)..(817): n equals a,t,g, or c
  misc_feature (829)..(829): n equals a,t,g, or c
aaacggactcgtttggaacccccattatagggtaagctggtacgcckgcaggtaccggtccggaattcccgggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcckagtckggcagatgcccctgaagtccagcgtgggctccaggcgtgtcttctttcaccaaagctgcccctgcgggagaggagatactttaagcgggtggtcctggcaagcccggaccaaaacggggacacctgggacttgaagaagttttcanggacaccgccccttggaaaggcctgggaacanctgctgnccggaacntgaaaagtgccgcaacgccccaaacccttggcaaaaggcgccccctggnttcaaaccctncatggcttgggna

SEQ ID NO: 5370 - DNA, 678 bp, Homo sapiens
  misc_feature (11)..(11): n equals a,t,g, or c
  misc_feature (54)..(54): n equals a,t,g, or c
  misc_feature (72)..(72): n equals a,t,g, or c
  misc_feature (325)..(325): n equals a,t,g, or c
  misc_feature (397)..(397): n equals a,t,g, or c
  misc_feature (536)..(536): n equals a,t,g, or c
ttcaccaaagntgccccctgcggagaggagatactttaagcgggtggtcttggnagcccggacaaaacgggnacacctggtactgaagagtttcaaggacacgccgctggaaggcctggagcagctgctgccggagctgaaggtgcgcacgcccaccctgcagcgcgccctgctmaacctcatgctggtagtctccggcgtggcgatcttcgtcaacgtgggcatggtggtgctaaccgacctcaaggtggccacctccctgctgctgctgctcttcgccatcttcatgggcctgcgggcctccaagtgccgggctgccttgaanagttgcacaggttgttcaccatccaaggattcgtggcccaggggccaggtggaggctgacacccaacttgtntccgcttgccaaaatgcgtgtcctgtctcgaggctgagtcagcccagaggggagctgccttttactgattcttcccagggttggcaccggccccaggagtgtagactggtgtgaagcatctgtcgtacgcgatcattcncctgctggctcattggttttcaagctgttttcagccatgctgacaggctcttaggaaggctggtaataaatcccgcagataaaaaaaaaaaaaaaaaaaaaaaaaaaaaaaaaaaaaaaaaaaaaaaaaaaaaaaaaaaaaa

SEQ ID NO: 5371 - DNA, 1039 bp, Homo sapiens
  misc_feature (937)..(937): n equals a,t,g, or c
  misc_feature (964)..(964): n equals a,t,g, or c
  misc_feature (971)..(971): n equals a,t,g, or c
  misc_feature (994)..(994): n equals a,t,g, or c
  misc_feature (997)..(997): n equals a,t,g, or c
  misc_feature (1026)..(1026): n equals a,t,g, or c
gctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccamcctgcaggagcagctaaagaaaaataaaggtttccggaagtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacgtaggttcttgctcctcggcaacgcaggctggaggcttcctctcctgtattcctttctgattctgacctccaacaatgtctggtatgaccctatcttccactgacatgtatacagtgtccctactgctctgccttttcttcaagaagtcagaccctgaccctggtcccttccagaataacctctttcacaaccatggcacccaaagtcaaagttgtatggggagtaaggtgggagatgttattccaggggctgcccgactgataagtgagactgcccagagagtccatactattggtcagaaacagaagaatgaccagcaccttcggcgtgtccaggctctgctcagtggacgccaggcaaaggggctgacctcagggcngctgggttctacgccagggctggctgntagtggngcctccccatgggggagccctcnggncccccgcatgttccttcctgctttcaccnggatggggcttcc

SEQ ID NO: 5372 - DNA, 678 bp, Homo sapiens
  misc_feature (56)..(56): n equals a,t,g, or c
  misc_feature (58)..(58): n equals a,t,g, or c
agtctgtcctttccctcgtgagaagctactgcttatgtccacagaccaggaggagntntcacgctggttaccacagtctgacttgggctatcagcagccagaaaactagaggaatcttatagattccagaactcaggatacctcagggatagtcacagccaagagtacaaaggaatcttcagtactgaacaaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttgggaaaaaaaaaaaaaaaaaaa

SEQ ID NO: 5373 - DNA, 1718 bp, Homo sapiens
ccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactactggagctgctggtgaaagaaacctctggaggccsggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaaaaaaaaaaaaaaaaatcgagggggggcccgtacccaatcgcctgta

SEQ ID NO: 5374 - DNA, 1486 bp, Homo sapiens
  misc_feature (1406)..(1406): n equals a,t,g, or c
  misc_feature (1414)..(1414): n equals a,t,g, or c
  misc_feature (1474)..(1474): n equals a,t,g, or c
  misc_feature (1482)..(1482): n equals a,t,g, or c
ttttttttactaccatttttttttaacactggcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggaraaggtgtcattgaattccgggacgagccggagcctttaaatgggtgcttccaccactacaggctcctgacacgagtaacaggcactgttgcttagaagaacacacgaakttgccgaacacagggtaaaatttccaaggcgctgatcgttgccctggccagggcctgatgaragccagtcagtacattctttttttcctacagwtcttgggtttsaaacttcagtttcagggaatttcaagtcaacaacaggtagaatgaataaacttggttaccagcctaataatgtgaattgctacagaattattcttattatgtaaggaaaacaaaaactttatggcagatactttaggctattaaattggatgttaaaatactgatttttttaaagggaagggagagaacagtattcttgttncattattntggcattcattcagtaaatgttttttaaaatggatactacaggggagctttggtaagggngggggctnggac

SEQ ID NO: 5375 - DNA, 948 bp, Homo sapiens
ccggggccccccccgagktttttttttttttttttgtaggttaagaaaactgcaggagttgtcatgaaattctattggaaagaatataaaaattatcttggttttaaattgataccaaagtctgtctagaaacaacccaaccactgcaaatttggtttttgcaagttaatttaattcaaaaaaatacttgtactcccgtgttttaaatggtcttaattattcatcaccataaaaagtagtttaggagaaaataaaatatttgaacaacagtctaaaatttaatagcactgtttagaataggtctgtttgtggcagacagaatccaaaatggctaatttcctaatcccgatgctctgtgtattaccgggagaaataatgaaattcatttaaaacctcagtctaagaaatcaaatgttcaatacttgctaatctaaatatctacattagtctgaatcaacttgttattgtggatcctattcacatctttcggaacaacatgatcgatctgtaaattccattgctaaaggcaactttatttataaccatcaagtcctcttggctctgaaaataaattctacccataccccattgcacttgtcaccaaggaatcaactaggtacgttctgattccctctcacctctctcttccccgactgggatggaaaccagactgatttctcccaactatgccaaactggcccatccatgccctctccttactaagctctcctgtagtatcattttaaaaacatttactgattgattgcataataattgaacaagatactgttctctccttcctttaaaaaaatcagtattttacatcaatttatagctaaagtatctgcataaagtttkkgttttcttacataataagaataattctgtagcaattcacattattaggctggtaaccaagtttattcattctacctgttgttgacttgc

SEQ ID NO: 5376 - DNA, 1054 bp, Homo sapiens
ggcacgagtgtgtgtgtgtgtgtgtgtgtgtgtctgtctgtgtgtctgtgtatgtgtatttctggctgtctgttccattgctctatatgtctgttttttatgctggtaccatactgttttgattactgtttagtaatgtattttgaaatcaagacatgtgggtacctcctgctttgttctccttgtcaagattattccaggtcttttgttgcttcttcatagacgaattaactgctgatttatgaacttgaatattctgatttctttgacagttagttctcattgtaaattgataaattatcactctggttttatacatcagtttttagctatggctaataacagtctttcctcacaattcatatttagcatgttggcaaaatcatattttggaacctgcaagacatagtctctggtctatagtaaatcaagctgctaggttgtagtctgacaacttgtgtaatattttagctctggatgatattaatttttaagattattaaattttatttttcagtgttttacattgacagcaaaattgagtgggaagtacatactaatttttctgtatcttagaatttctttgggatcattttaactattttaatgttttaaattttattgtgaatctttttaaggaaggctgagctgttgctacaactgtaaaataaatattcttaaagcaggcagtgatgatcaaaatcttgccatttgaccattaagctgctagaatatgagagtgataatttaggaatgagttgattaaagaaaataacaaagtagtttactaaggaattaataatagcaaataaaaggtttaacaaacaacaataaatattctgttgatattgcaccttaactttccatcatcatcttgggagctgacttttttgctgatttcattccgataagataagttcatttgaccacgtgattattatttaatacatctactgataactctataatagaaagtggcagattttagataaagggtttgtgatttttaaggttgatattaacaggtagtatcataaaaaaaaaaaaaaaaaaa

SEQ ID NO: 5377 - DNA, 1405 bp, Homo sapiens
  misc_feature (1403)..(1405): n equals a,t,g, or c
gaattcggcacgaggcagctttggacatgtcgggcctcatagggagcatggggtgtggaagtggtggccgtgggctcaaaagctggctgcttagtttaccagctgtgtgatctcaagcagatcaccttcttcttcagagcctcagtttgcctgtcggtcatgccctgcctggaggccgtggccttgatcctgcttatcctgctggttccagacccaccccggggagctgccgagacacagggggagggggccgtgggaggcttcaggagcagctggtgtgaggacgtcagatacctggggaaaaactggagtttcgtgtggtcgayyctcrgagtgaccgccatggcctttgtgactggagccctggggttctgggcccccaagtttctgctcgaggcacgcgtggttcacgggctgcagcctccctgcttccaggagccgtgcagcaaccccgacagcctgatttttggggcactgaccatcatgaccggcgtcattggggtcatcttgggggcagaagctgcgaggaggtacaagaaagtcattccaggagctgagcccctcatctgcgcctccagcctgcttgccacagccccctgcctctacctggctctcgtcctggccccgaccaccctgctggcctcctatgtgttcctgggccttggggarctgcttctgtcctgcaactgggcagtggttgccgacatcctgctgtctgtggtggtgcccagatgccgggggacggcagaagcacttcagatcacggtggkycacatcctgggaracctggcagccctatctcacaggacttatctctagtgtcctgcgggccargcgccctgactcctatctgcagcgcttccgcagcctgsarcararctycctgtgctgcgcctttgtcatcgccctggggggcggctgcttcctgctgactgcgctgtacctggagagagacgagacccgggcctggcagmctgtcacagggaccccagacagcaatgatgtggacagcaatgacctggagagacaaggcctgctttcgggcgytggcgcctctacagaggagccctgaggtccctgcctgcactcgtcctgcctgcaagcctcccgttggtccccacagcagcagtgcctcggttcctctttggctgtcctcggggactccggctgaggcacatctgccacttttgaattcccggctggagagctggcaggaccctgtggctgggctgggaatggagctgtcagcactctgcgtgggaggcctgggcctgtgcctgcatcccgctcaaggctgccccagcctggggtccccagcctggctgctgctgggccctgrataaagagaggccagtacaaagcccatggattttgggcctgtaaaaaaaaaaaaaaaaaaaaannn

SEQ ID NO: 5378 - DNA, 571 bp, Homo sapiens
  misc_feature (26)..(26): n equals a,t,g, or c
  misc_feature (32)..(32): n equals a,t,g, or c
aaattggccccttgttggtttatgtnagtcanactcatgaatctttgaagctttggcaacttaaggagaccttgattcaatccttccctgctctcgtgagaagccttggccctggcttactgttcgggcctccaatagccacagggktgactcaggcaggtgacatggctgataaatcacaggctggacccaggggttcagtttccagtgtggcctggggtccttttcctggggggtccggggcgctggctttctgtcctttaatactcagaagccactgaaccatgttcacaggtggcttcccatggagtggcgggcaccacctcttccaggatggaacttggggtggatcagtagagagtagggaccaagatgagttagaccccatggcaggtggggagggcagcagggttggccaggctgtgatgtgctccagcgctgttctgagactccgctctgggcccggagcaccaagcccaccgtccttggtggtgagcagtgccgcacccagcagagcaggtccagaagcctgtccagaacactcgtagggggggcccgtacccaatgcctg

SEQ ID NO: 5379 - DNA, 2224 bp, Homo sapiens
  misc_feature (2186)..(2186): n equals a,t,g, or c
  misc_feature (2202)..(2202): n equals a,t,g, or c
  misc_feature (2218)..(2218): n equals a,t,g, or c
acccacgcgtccggcagaagaggagaagaggttgtgtgggacaagctgctcccgacagaaggatgtcgctgctgagcctgccctggctgggcctcagaccggtggcaatgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaaggactcgacccagatgtcggccacctattcccagggctttacggtatggctgggtcccatcatccccttcatcgttttatgccaccctgacaccatccggtctatcaccaatgcctcagctgccattgcacccaaggataatctcttcatcaggttcctgaagccctggctgggaraaagggatactgctgagtggcggtgacaagtggagccgcamcgtcggatgctgacgcccgccttccatttcaacatyctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatggtgagtgcaagttcttctggcctgttcctgagcccatcattggttctgctccccaagtgaggaggggtggaggagttgttttgtggattcttccactattgcttagtgggtataaaagcagaggaccacaggcagggcttgataccaagcctggctgtcaggggaaaagttgcaggcctttaggaccgaaagacccgggctgctaagagaattggtgacaatgtgtraggacagataatgctactttgcacatgttcagcaaatgaacttcccctccactctgtttctgttctcccagaaatatcagttttttcgaaaatcctcacttcttgaatgtttgctcaggtgggragggagaagttgtttttgtcaattcttccattattgcttagtagtactaggagcagagcacagaggcagaacttggtatccaacctggctagcaggggaaagttttcagacttttgggacagagagtcctagcccgctgagagaactaaggacaatatatgaaggcagacgatgacatctagacatgttcagtcaatgaattttcccttcactcctttcttgtttactctgaattatcatatttttttcaaacatctttacttcctgaatgtttactcttctgttccctaattcctaccctccggtccagtccagggagtcctaagggagacctgggggtaaaagtcatctatcttttgtctagaacacctgcatcgttcatccattcagtcttcattcagcaaactcttccacatgcctttccattgccagttctgttcccacacctttctgtkctctggagacctggaaagaaccctgcctatggatgtgttttccaggtactcccagcctagtaggaacagtcccccacaagacattcccagtccacataggcaaggatggagttgagagcaagagaagcatggctgggagwacagaaagtgtgatagaaaatgttttcaagccaaatcttggttggctgttcgcttgttgatanccaagttaccgaaganggcttgaaatttgggntaaatc

SEQ ID NO: 5380 - DNA, 1669 bp, Homo sapiens
  misc_feature (1162)..(1162): n equals a,t,g, or c
ctcgagtttttttttttttttttttttttttttgacagcaccgttttattcatgacaatctgcaaaaaaacaggtggatgggtcagaaagtcactgcaagcytacattcaggggctccacccgcagccaaagcccgccctcggcgcgcatgatcaattccagcttcctgcggggctcagtgtggtctggcaggaaccggaagtgcagcagcatcaacgccaggaccactttcatctccgccatggcgaacgcctgcccgatgcagttcctgggccctgcggagaaaggaataaaagccagaggtgacctccccttgctgttctctgggtcaaagcggaaggggtcgtagacctgcaggtgagacaaagaaggtttgmcagtgggatttcctatgtccagcagccttggagagacacttgtgtgtgtkktggggtgaggtgatgttggattttcctcatcaaawccctgccccctccactaggaaccttggaattcacacacacacacacaaaagtagaggatgggggtggtggtggtgaatggggaaggcagcacctcaggatccggccacacagttgggttgtgatggacccctataatatcgatgaggcaggtaatgcctttggggatgactcggccatctgggagaacaatgtcctgggtgcagcatcgggagatgaagggagctgggggatgtaacctcaggctctccttcacgcacatggtcaggaagggcagctgggccaggtcgtcccattcaatctctttaggatcgcggtccttcagaagctcttgcacctcctgtcggcagcgctcctggtattctgggtgcctcgcaaggttgtacaggacccaggagaggccactggccgtggtgtcatggcctccaaacatgaaggtgtcagcctctgctcttatatcctcatctgacaatgccttcccatcttcatccttgctcagcaaaagcacatcaatgaaatccaaagtcttggacttggctttgtctttgaaaraatcrtcaataccctragtrgggagggtgcgacgccgstcccggwtgacagcgtytgtgaagtcatgcaccaggcggcaggccctgtggaagcgccgcccgtcatgggagaggtaatacagaaagtccatgtgctggaggatatgctgncttcttttctctacaagggcactgagctccaagatggtggcaatatattcactgggcctctcctgacaatggctgtcaaagctgaagatgcatttctgtagactgtccaaggtcatgaggctgatgtgctcaaacatgtccagacgactgctgccctctgaggccaggtgctgccacttgtcaagcatgatgtttgcactcttgttgaagatcgttatataggacttcaggatgttgaaatggaaggcgggcgtcagcatccgacggtggcggctccacttgtcaccgccactcagcagtatcccttctcctagtagggcagccaaggacaatgggcaagagcagcacttcccctaccctccccgcaaggttgtccccaacccctttcacctgcaggtactcacccagccagggcttcaggaacctgatgaaragattatccttgggtgcaatggcagctgaggcattggtgatagggggatggggtcaaaggcgtctctatcggcc

SEQ ID NO: 5381 - DNA, 664 bp, Homo sapiens
  misc_feature (31)..(31): n equals a,t,g, or c
  misc_feature (63)..(63): n equals a,t,g, or c
caggctctcaatacggactcactcatagggnaaagctggtacgcctgcaggtaccggtccggnaattcccgggtcgacccacgcgtcgcrgagctcttacttctccagcaacrctcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtctttttttttttttttttttttggtatattgctgtatctactttaacttccagaaataaacgttatatrggaaaaaaaaaaaaaaaaaaaaaaaaaaaaaaaaaaaaaaaaaaaaaaaaaaaaaaaaaaaaaaaaaaaaa

SEQ ID NO: 5382 - DNA, 974 bp, Homo sapiens
ggcacgagccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgttgcctcatgactcacaacaaaggggtcagttttagcctggcagcctccatcgatgcttctcctgccctctgtgcccttccacggctgggacatgccttggattctgatgctgctgttcacaatgggccagggagttgtcatcctggccttcagatcgtgtctggaggcagaggtccgtggggttccaggcagaggaaaccgaagcggtgttaaaactgtggtggaagccccagcagtttttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggatgtacctgggagacctgtgcaacagcgccgtggcaagccatgtggcccctgcaggcattttggctgcagcagctaccgccctgacctgttttttgccaggactgtggagcggatagggggagtaggagtagagaagggaacaagggagcaagggaacaagggacatttgaacatttaatgtgagaagacaaacatcctttgtgagtcattaaaatttatgaaccacttaaaaaaaaaaaaaaaaaaaaaaaaaaaaaaaaaaaaaaaaaaaaaaaa

SEQ ID NO: 5383 - DNA, 764 bp, Homo sapiens
  misc_feature (526)..(526): n equals a,t,g, or c
  misc_feature (629)..(629): n equals a,t,g, or c
  misc_feature (642)..(642): n equals a,t,g, or c
  misc_feature (710)..(710): n equals a,t,g, or c
  misc_feature (732)..(732): n equals a,t,g, or c
  misc_feature (737)..(737): n equals a,t,g, or c
  misc_feature (747)..(747): n equals a,t,g, or c
gaattcggcacgagcctgaaagtccgtggcttcattcttgaagtcagcgagaccacgaacccaccggaaggaaccaactctggacacagtggcatggtctcggctctctgcggcctctgcctcttgggttcaaacgattctcctgcctcggcctcccaagtagctgggactacaggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaanaggagctgaaggtccccctagaggagtatgtccacaaacgctaccccgggctggtgaaggtggtaagaaatcagaagagggaaagcctgatccgcgctcgcantgagggctggaangtggctaccgggcaggtcactggcttctttgatgccccacgtggaattcaccggttgctgggcttganccgggtttatccggatccaggnaaaanccggaagcgngggaaccttccccttca

SEQ ID NO: 5384 - DNA, 433 bp, Homo sapiens
  misc_feature (10)..(10): n equals a,t,g, or c
  misc_feature (25)..(25): n equals a,t,g, or c
  misc_feature (203)..(204): n equals a,t,g, or c
cctaatagtnagtgataacagggtncaggaaagtgaagagaagcccagaaccatatgacatccctgggtccaaggtactggccctagttgtgaaaattgccccacatataggtggccagccatcaagatccccagttttggagctgggcgtgggtgctcacgccctgtagttccagtgattcgggaggctggggcaggaggannacttgaggccgggagtttgagaccagcctggacaacatagcaagagaccctgtctgtataacaagtttaaagattgactgggcgtggtggtgcatgatggtagtcccagctactcgggggaccggggcggaaggatcgcttgagtccagattccaagctgcagtgggctgtgattgtgtcactgcactccagcctgggcaacagagcgagaccctgtctcttaaaaaaa

SEQ ID NO: 5385 - DNA, 1243 bp, Homo sapiens
  misc_feature (131)..(131): n equals a,t,g, or c
cagtttatttgtgcagatgctggaaccaaactagctgagtcaacaatcctgagcaagcagatgatagcctctgtacctggatgtgggactgcagcgatggagtgtgtgaggcagtacatcaacgaagtgcntggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatgagtggactcctcggcgctcagtgtcaacactctggtttagcaataatgggtttaaaaacaaacaatttgatccaagcaggttggggaacatattggtactgtacattctctttctagtttagtaaaagatgtgcaaaggccagagagggccgaaaatgaaaaaaaaaaaaaaaaaaaaaaaaaaaaaaaa

SEQ ID NO: 5386 - DNA, 865 bp, Homo sapiens
  misc_feature (445)..(445): n equals a,t,g, or c
gaattcggcacgagcagacctgggctcgagaccataactgtttggctttaacagtacgtgggcggccggaatccgggagtccggtgacccgggctgtggtctagcataaaggcggasccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccarctggggaacaacaccytytcmagccanctccagatcgacaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaaaa

SEQ ID NO: 5387 - DNA, 882 bp, Homo sapiens
  misc_feature (117)..(117): n equals a,t,g, or c
gaattcggcacgagcagacctgggctcgagaccataactgtttggctttaacagtacgtgggcggccggaatccgggagtccggtgacccgggctgtggtctagcataaaggcgganccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaagtaacctgcttcggggcatagacagcttattctctgcccccatggacttccggggcctccctgggaactaccacaaagaggagaaccaggagcaccagctggggaacaacaccctctccagccacytccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagc

SEQ ID NO: 5388 - DNA, 1091 bp, Homo sapiens
gcctgakcccccagaatgggcacctgggcagacaccttctctctgctcttggctcttgccgttgccctctacttgggctactactgggcatgtgtgcttcagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgcctatcctatggtaagacctgcaggcccgtacaatccgccagtttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcctaaaaa

SEQ ID NO: 5389 - DNA, 1283 bp, Homo sapiens
ggcacgagcacggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgcctctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacaaaaaaaaaaaaaaaaaaaaaaaaaaaaaaaaaaaa

SEQ ID NO: 5390 - DNA, 1348 bp, Homo sapiens
gagctccacgcggtgcggccgctctagaactagtggatcccccgggctgcaggaattcggcacgagcacggttcaaacgacccggtgggtctacagcggaagggagggarcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcmccgcccggactggtcttccccggaagacaaggataatcctagaggackagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacaaaaaaaaaaaaaaaaaaaaaaaaaaaaaaaaaaaactcgag

SEQ ID NO: 5391 - DNA, 589 bp, Homo sapiens
  misc_feature (519)..(519): n equals a,t,g, or c
  misc_feature (588)..(588): n equals a,t,g, or c
ggtatagtatattaatggctttatccgccatttaatgtggttcccatgaggtttaggtagaccatagatactgtttcaattagaacacttcatgaggatttagtttctctgtctatgggtcctgtatctgaactctccatttttattcttttgtttgttttttgttttgwtttctccctgatgcctgatatcagaagaactctccatttttggcttcattctctgctctatccacatgagacagaccaatgtctgcaatctagtgccatacctttccaggttttttatgtccaacaaaaaaagagagcatctctttctagtagctcccacataattaagggtatagcccctctcctgaaccaatcagtcaatcacagtggtcccatctgaccatggggatgttccccaaaggaaatcagggtgktatttttcaaaaggaagaagaaataaatgctggaccttcataacaaccaattgsccactaaaagtgcagtcatatttcttgatgaaatagacctntccttgsatactgggctycatgacmcatgrtcatgggtagcttgaaaaattctgaagccttaataatcnc

SEQ ID NO: 5392 - DNA, 692 bp, Homo sapiens
  misc_feature (21)..(21): n equals a,t,g, or c
  misc_feature (68)..(68): n equals a,t,g, or c
  misc_feature (72)..(72): n equals a,t,g, or c
  misc_feature (95)..(95): n equals a,t,g, or c
tactgggctccatgacacatngatcatggttagctagaagattctgaagtcttataatccactttgcnagtnacatttatttgtagctcaagggnactgttaagggaaaggggagcagtgctaaaaacaaatcccattccaatattattaaaaaaaccattgctctgcccttcctttattcacaacttagttcctcatcctcatcttccccagctcctccttttcagcaatttcctctgtaggtgcccctaccactaactcscacagattcccccatctcctttgrmgaaaaaagctagatgctcccactccctttatttcttccacagtaaccagcttaactagcacacggctttgtacatggtacacagttaagtaatatttgtgaaataaatacggaacacttaagggaawtaaaaagcaatctatcctcatcargaatgagctgagaatccctgagatagcctatttagcagcttagcctgaattctgttttagtttctgtttctggaaactcttcttattttaagaaagaatgattcttataattatttcatatttgttgatattatccagtcttagccagttatcaaaatggtcttgagaattaggaggggaaagcataatgttataaacatttcagcatattgtgcaagtaaagtcctggtagtctgggtaattctagaactcga

SEQ ID NO: 5393 - DNA, 559 bp, Homo sapiens
ggcacgagctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatgaaaaaaaaaaaaaaaaaaaaaaaaaaaaaaaaaaaaaaaaaaaaaa

SEQ ID NO: 5394 - DNA, 898 bp, Homo sapiens
tcaaaagctggagctccaccgcggtggcggccgctctagaactagtggatcccccgggctgcaggaattcggcacgagctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatggctcatcggagtttatacttatttcttagaaaatgtttcctgttatttgctggacaagtcccaaagaacaggcagatgttcttattaaaagatcagcctataagattggtcaggaccaggcgcctctggccacgtgcctctcccctccaggcctgcggtctgcggtggcacctggcagctggaccacagccaggagaagggtactattagccctgcttcaaacatgcagaaactgaggcccggggagattaaataacctgcctgaaatgacagtgaggtatgcgcctggatttgagttctgctctggctcgtgcc

SEQ ID NO: 5395 - DNA, 819 bp, Homo sapiens
  misc_feature (712)..(712): n equals a,t,g, or c
  misc_feature (758)..(758): n equals a,t,g, or c
  misc_feature (761)..(761): n equals a,t,g, or c
  misc_feature (807)..(807): n equals a,t,g, or c
gcctagcagcacacagacagcgaagcgggtgaccatggggtggccacggccgggccgagccctcgtggcagtcaaagccttgctggtcttgtcgctgctccaggtgcccgcgcaggcagtggtacgggccgtgctggaagacaactcgagctcggtggactttgcggatctgccggcgctgttcggcgtccccctggcccccgagggcatacggggctacctgatggaggtcaagccagccaacgcgtgccatcccatcgaggccccgcgactgggcaaccgctctctgggcgccatcgtgctgatccgccgctacgactgcaccttcgacctcaaggtgctgaacgcccagcgcgccggcttcgaggcggccatcgtgcacaacgtccactccgacgacctcgtgagcatgacccacgtctacgaggacttgaggggccagatcgccatcccctcagtgktcgtgagcgaggccgctcgcaggacctgcgggtcatcctgggctgcaacaagtcggcccacgcgctgtcctgccgacgacccaccgtgccacgacctggctgtcaccccgtgctgaccgtgtctgggtgctgggctgtaccctggcctggtcgtatagccttctttgtctgaaccacctgtggctctgggcccaggcctgttcagcacagacggccggtgagacgtctactgcagaaggccagtccgaccntacgtggacaacgactggtgcattgctgatagatgagagggacaantantctgctgtcaactacatgaatgatgacctgtttcagccccgggttntgcgggaaaagg

SEQ ID NO: 5396 - DNA, 677 bp, Homo sapiens
  misc_feature (1)..(2): n equals a,t,g, or c
  misc_feature (64)..(64): n equals a,t,g, or c
nnacccaaccgtgccaacgacctgggattgtcacccccgtgctgaccgtgtcctgggtgctggnctgtaccctggccctggtcgtatcagccttctttgtcctgaaccacctgtggctctgggcccaggcctgctgmagccacagacggccggtgaagacgtctacctgccagaaggcccaggtccgcaccttcacgtggcacaacgacctgtgtgccatctgcctggatgagtatgaggagggcgaccaactcaagatcctgccctgctcccacacctaccactgcaaatgcattgacccctggttctcccaagccccccggcgctcctgccccgtgtgcaaacagtcggtggccgccacagaagacagctttgactccaccacctacagcttcagggacgaggacccctccctaccgggccaccggccccccatctgggccattcaagtccagtacgctcccggaggctggagctgctgggccgcgccagtccccactgccactgcagcaccacgtccctggaggcagagtataccactgtctcctcagcccctcctgaggcccctggtcagtaaagatctagggcagggaggggggtgcaatgaggaatgtttctggtctgaaaagaataaagtgggtttgaaagcggaaaaaaaaaaaaaaaaaaaaactcga

SEQ ID NO: 5397 - DNA, 1518 bp, Homo sapiens
  misc_feature (1146)..(1146): n equals a,t,g, or c
aggagaaactctaaaaactgcagatattatttcatgctatatgttccatcctctgatgagaatgtgaggaaagaaaattgtatcctgcatggctgaaaatggtcccctacaaaaatatcatgttggacaactaatctgagatagtggtatctctggaaagcagtttagcactggtgagtttggactttcatggcaggctgccttggttcatatcttttggtaatgatacttatcctctgtraggcccatttctttatttgtggaaatgaagacaatagagtgcttagatataatttascaacaatgtccgtcacatagtaaacacgtaataaacggtagctcttattgttattattattactattattaccttgaagacaggggctctgtcttgttcatcattccatctccagctcttagcacagtccctggcacaattcaaacatgtatttggatgaatgacaaatagctactgaatatttgccctgttccaagcattgttagaggtacatgggacagggcagtgaacaaaacagacaaaacctcctgctgtctcagagttcacactctaatggggagacccaggcaatgaggaaataattaaaatatacaatgtgtcttatggcaataaatgacaaagaaaaataaagcagaggtgagaaacagtggcagtgttttggtgatcatttgctttgcaacaagccactccccaaagttagtggcctaaaacaatttaatcacagttcatgttctggctacaacaatacacatccctctcatgtgcaaaatacactcactcctccctcagagcctcgtaccattaagggttcaggttcaaagcttaagatcttatcctctgaagtaggtttagggacaaacaagtcttctcaggtacttcttctggggacacagagacttgtgaactaaaagacaagttacctaccttccaacacaactgacatgcaatggggatataggaaaagataatttcaataggcgcttctgtgcaaaagcgggggaaatgagagtcactcagcagtcacggttcatattaatctaaaatctagccaggcatatatcccaagtcttcctgatgtgaggacaagaattatttcttgattagggctcacttwwtctctttgaggntggttcgcctcagcttttggatttgtcctctgaatcatccttccttgtctataaaatgcatgtatatactcatacatacatagagagaaagagagagagagagagagagagactctgtcacgcaggctggagtgcaatggtgtgatctcagctcactgcaacctacaactcctgggttcaagcaattctcctgtctcagcctcccgagcacctgtagtccctgctactcaggaggctgaggcaggagaattgcttgaatccgagaggcagaggttgtcagtgagcagagattacaccactgcactccagcttgggtgacagagcaaggcttcatctcaaaaaaagacaaaaaaaaaaaaaaaaaactcgtag

SEQ ID NO: 5398 - DNA, 812 bp, Homo sapiens
  misc_feature (794)..(794): n equals a,t,g, or c
  misc_feature (806)..(806): n equals a,t,g, or c
  misc_feature (810)..(810): n equals a,t,g, or c
ggcagaggctcaccccagcagagattgagggggaaccgtgatgaaatttttaagtattctgcttgatgataataattttyctcttatgttaatgttggctccgtttgggtgtttagcttttgaaaggagtatgaaaatgcggaatggggctttggggcttgaggaggtgtgatctctagtgtttaaaaaatttaattgcacaaatagaaataattcacccacattattgaaccccactaaagcatatcctttttgtccatattcctttcctgctgccctcgtgtgtaccattattactcagttgtgatttgagctcgttccacttaaagtcattcatagatacttttgcgtcgtgttkgaatatttattgaatttctattctgtgttttacttaattactttattatggaacctttacacaggtctggtgtacttgttctttgaaaagtcttatgttgaccaccatcactgagcatatagctttttccttatttccttgggataattacccgaagtggaaataccgaatcaaacttctgttttctttctttggcactattatataaattgttttccaaacaaggcatgtttacaatagacatttttcaaaatctgggtatttgtcctattttgctctctgtatgcagaattcagcggggtgccaagtcgttttctgtgtgggttgagagacaggctgtgcagcccactgttgcataggactaactactacaaatcatgctgagaccgagctatttttgctgcttagargctttgcagccttgagtaagtttcgncatctggaaacnttgnaa

SEQ ID NO: 5399 - DNA, 455 bp, Homo sapiens
  misc_feature (245)..(245): n equals a,t,g, or c
tgcctctgcccagagatgtcccaaaggccctcacakaggccgggccagggatgtggctgccacagctgagaccaagggctctggctggcccgtccccaccaggtggccctgccctccccaagttgggggttgtggcacttggggtcaggcctagccacgtaaggacacaggtaacaccctgaggatctggcattggcagcttcaggcctaactttcctggtcagggccccttaaggtggcccggngcacattggtttcatttcgatgagactttgtcagaggcctggtctggtcctggccctaccgccccagctgtccttcagcacagctcggggtggggactccaggatgctgggtctgccccttgggagggsaacttctgggaaggttcagggtgattccacaactgttaagctgaggtttggattgcagttgggagttttgggacagagaga

SEQ ID NO: 5400 - DNA, 764 bp, Homo sapiens
gcggacgcgtgggcggcccggtgtccagcgcagcccagggcttcctggggggcagcaggagtgcctgggggtcaccgccttcaggacaatggcctcagtggctctttctttctgccctgaactggcacctgcacctcctctgcttcctagagggtgacctgggccgagccgcccagtccttcttcccctgaggccagaggggacgccccgcggccacatcacacaggatcctcagcagccatagtctcgcttcagggtgtccagtgtttcgaggaggagaggggacaggggccaggtccactcccttggccctcctcttggaccccaaggccaggccggatccttttatcccgtggggagcccctgcctcggccatcgggatgaggtccctcaagtccctgcacaagcaggtcagagacccacccacatgccgttcctgggctacgccacgcgccatcccccggggctgtggacgcacccagcccccgacagacaggcgccctgagagctccgaaggcgcgatccccatccccaccagtggagaagccagaaccgcgattgttgcatctgggaaaacccagctggagccgaacggcccgtgcccccactgtaattgtgctgaaaatgtttctcaaatgacccaaattggctcttattttttctaatggccctttcaaagtattcatgaaattgatgctgtgtcataaaacaaaaataaaagatttcacagcaaaaaaaaaaaaaaaaaaaaaaaaaaaaaaaaa

SEQ ID NO: 5401 - DNA, 2435 bp, Homo sapiens
  misc_feature (455)..(455): n equals a,t,g, or c
  misc_feature (2107)..(2107): n equals a,t,g, or c
  misc_feature (2435)..(2435): n equals a,t,g, or c
atgaagggtcgttggtgggaaagatggcggcgactctgggaccccttggtcgtggcagcagtggcgrcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggrwtcggatgcagccagggcctgtntttgggaaacatggacaaatttgtggggctgggagtatttgtagacacctaccccaatgaggagaagcagcaagagcgggtattcccctrcmtctcagccatggtgaacaacggctccctcagctatgatcatgagcgggatgggcggcctacagagctgggaggctgcasagccattgtccgcaatcttcattacgacaccttcctggtgattcgctacgtcaagaggcatttracgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctgggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttncttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaaaaaaaaaaaaaaaaaaaaaaaaaaaaaaaaaaaan

SEQ ID NO: 5402 - DNA, 1657 bp, Homo sapiens
  misc_feature (266)..(266): n equals a,t,g, or c
agaacggccttccccacatcttccagcacctgcgcgcctgaatccgtcccacccaggcccagacgcaggcttcttctcgggtcttggtcctgcatcctctctctcccagagcctccgttaggggtgggaaaggactttgccataggtcgctgaggccaccatctgctctcttactggccaagggcgtaaaaagatagtcytcccattagctagagagcaaaccccagaaagcctattggctgcgccgtccgcgggccttggtccgntttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggcatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagggacttgcggttaatcgaagtcactgagaaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacagraaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcakcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgawraaaaaaaaaaaaaaaaaaaccccggggggggcccgt

SEQ ID NO: 5403 - DNA, 1064 bp, Homo sapiens
gtgttgttctgttaaaagactgtccactgttttctttttcagtaattaatggtcacacactgtgtttacggctgttgctagaaattgcagacaacccggaggcggtcgatgtgaaagatgccaaaggacaaacaccactgatgcttgcagtagcatatggacatattgacgctgtttcattgttacttgaaaaggaagccaacgtrgacactgttgacatcctaggatgcacagctttacacagaggggtatgtacatctttctcagctctagtcaagcaatttttttaatgagctgttttcttttttagcaaacaattacaaagggcctactttgattggatttttagcaaaaaatgtttagcaaaaattgtttcctaatacaaccaattaaccttattcagtccaaaagaaattacaaaatccttggcaaaggcaaaataatggaaggttttgctcttaagatttcatgttagattgtgataatagatgcatgaacacctactgctggtgaaattggttctgctttctgactacaaaatacaagtatatcatagaaaatttgcagaatatttttttttaaagcccagagaagaaaatcacaatcaccagtaatcatacctcctggagataaccactatttgatgtatattatctccaatcttttttctatatatagatttgttttagattttaaaaagagaatactgaagatatcatttggattctgcttttttctcttagtatatcaaggatcttttttcatttcatttttttctgcatcatgatttttaatgcctcattgtgttcaagtgtcatagtttatttcaatgattacctggttttcagtagttatgcaatttctaattgtttgtccttacaaataatgccaaaatatgtatcctgtgggcaattatttgcacacatctgttgaagtgtttggtttttttttttttaatctcactcttatcacccaggttgcagtgagccgagatcacaccactgcattccagcctgggtgacacagcgagactccatctcaaaaaaaaaaaaaaaaaaactcga

SEQ ID NO: 5404 - DNA, 3067 bp, Homo sapiens
ggcacgagcaatgggacttatcgctgctgatgttaaccttgatctcttggttcaggtggtgcctgccagctgtctccactgtggagttactatttttccttttccccattttattcatcagaagccagtcactaagcgaggtcaaactccaggacaggggaattaagtgccaccttctggagagggagcattcacatttattacttgggatccttctgtaaggaagagctgtttctcctctaaaaaactctttaatccttttaagcctcaatttcttaattgtgaaatggggctaatacctgtatccaaccaagggagtagttagaaggtaacatgataggtggaaagcacttaacataggcaaaatgttattatcaggaatgatcgagagacccatccaactatctgaaggagtcacttaactctactgtactgcagcgctgtaaagtctgcatctttcactgggggtaaaggcccccagtccctgagacgggccagtttggagacaggctggttttttctctgttctcctgagagcccttcagatgagaagggaggtctggagacagaatgccaaaagcccattaaaggcacggccttgcatttcagagagggagcaggtctagagaagaaccagaggagctcagctgagatatggtgtatggattggattttggtagaagatgggaagaaccaaacacctgagaaaccactttgaagatcggggtcagagtaaggcctaacacatagttggctcccagtaattattggttgattgaacagctcaaagagcaactcgaccaagaacactggactgggagtccagttacttggatcttgcattcctgatttatttttattttatatgtattttttctatttttttgagacgaagtctcactcactctgtcgcccaggctggactacaatggcacgatctcggctcactgcaaactctgcctcccaggttcaagcgattctcctgcctcagcctctcgagtagctaggattacaggcatgcaccaccacgctggctaatttttgtatttttagtagagacggggttttgccatgttggccatgctggtgtccacctcctgacctcagttgatcttcctgcctcagccttccaaaatgttgggattacaggcgtgagccaccgtgcctggccgtgatttattttttttgtgtatgtttgtttttgtcaacttgctgtgtgaccttaagcaagttacttaacttctctgggcttcactttccatggatgaacattgtaaagaggctggagagagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgttttcattacaaataagaccaccgagtgggctcctggcgtgggggcgggagcagccgcgcgcagtcttcagaggcagccccccaggctgtctctggagggtgtgtctctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcagaggtggggtgcgggcgaggggacgatgcattatttttaatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaaggtcaggagcggcggtgtggatgtcccttggctgcaggccccgccgcgcactcccttcagtccttcccttctctagggaccaggtagcatcagtgcctggatctcggccttgtgtgccctgctccctgccccacctactaagaaccaagtctggttcaccggctcccaagagctggaacccattctcagctagctgggggcccaggccaccccttccctccagacctgtgtgccttctgccctggctccagggccccccacaccgtgaccagggcgggatccctatggggctggccagtcggcaccgtgccaggcccacagtgccctgggcgtccatggaagtcgttctgtgtctttaaaatcagaaggaagacattaacctttaggctgaagaaaatgttttagtacacagcaataacttatttgtctttatccaacagccataaaatataactttaaatattctattgatagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaaaaaaaaaaaaaaaaaa

SEQ ID NO: 5405 - DNA, 87 bp, Homo sapiens
aagggcctggagtggataggacacatcgattacactrggargaccractacaaatcgtccctcaagaatcaggtctccgtatcacaa

SEQ ID NO: 5406 - DNA, 678 bp, Homo sapiens
  misc_feature (7)..(7): n equals a,t,g, or c
  misc_feature (25)..(25): n equals a,t,g, or c
  misc_feature (31)..(31): n equals a,t,g, or c
  misc_feature (37)..(37): n equals a,t,g, or c
  misc_feature (594)..(594): n equals a,t,g, or c
  misc_feature (654)..(654): n equals a,t,g, or c
ctgaccncgggggggggggaacggnaacggnaacacnccccttactattgggaaccaaagctggagctccaccgcggtggcggccgctctagaactagtggatcccccgggctgcaggaattcggcacgagtttggccgggcgtgatagctcaggcctgtaaatctcagcactttgggaggccgaggtgggcagatcatgaggtcaggagttcaagaccagcttggccaacatagtgaaacaccgtctctactagaaataccaaaaattagccggacctctgatgcctgatgtgcaggggccctggcaccctgctcacccacccatcccttctgctgccctttgcctgctctggccacactgccttgctgctccaaaatatgccaggccccgctgcctcctggtctttgtgctatgtgaccgctctgcctggaatattctactctactctgtaggaagcaaagtttcagggctttgctcaaattgctcccttgtgccgggtgtggtggctcatacctgtaatcccaaagtgccgctgggtttgcaaggctgtgaactaccatgcccggcagagcatttaatattctccaaatgnctttcctcgtgtgctacctgggctcactgctttctggggctctcgkggtgctggtgtctncacccccacccccaccccagctgg

SEQ ID NO: 5407 - DNA, 1031 bp, Homo sapiens
cgtggggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattcttaaaaaaaaaaaaaaaaaaaaaaaaaaagggcggccgc

SEQ ID NO: 5408 - DNA, 520 bp, Homo sapiens
gcttctatgggctttgcaccaccctctaggctgctcccgcctgggccatgcagcgcacctgaggggtctgaggtgaccgctcctcagagccgcccggcagcctccctggggcgggcctcagcactgcagccccgtgatccggcctggcgtgggctttgctgctttctctgcccggtggcctgaggagctcgagtgcccgcctgcccccagagccctttcacggtcagggcctgagctctgtgggtgccattaggaggagggtctgcagatctgtgcggttgggggacccctggggcatggaggggaccacgcgtcccttcccgtccgtgccctgccaggctgtcctcacagcagcgtcgtcacaggggaggaaaccagggcagcggcagcggctcctggtaccaagcataccttaaaaatgagcccatggatgttgcagtgagccgagatcacgccactgcactccagcctgggtgacagaagcgamttcgtctcacaaaaaaaaaaaaaaaaaactcga

SEQ ID NO: 5409 - DNA, 494 bp, Homo sapiens
  misc_feature (15)..(15): n equals a,t,g, or c
  misc_feature (18)..(18): n equals a,t,g, or c
  misc_feature (158)..(159): n equals a,t,g, or c
actgcagcgcatgcnacnacgccccggctaaattttggtatttttggtggagacgggttttcacctttttggccagattgtctcggtctcttgaccttttgatccacccgcctcgcctttccaggttgctgggattacagttgtgaccaccgcacctnnccagctttgaattcttaaaaaatgttcagctgaggccagacacggtggctcacacctgtgatcccggcactttgggaggccggggctggtggatcacagggtcgggagatcgggacatcctggctaacacggtgaaacgtcgtctctaccgaaaatgcagaagattggccgggcatggtggcgggcgcctgtgatcccagctactcaggaggctggggcgggagaatcgcttgaacccgggatgcggagattgcagtgagccgagatggcgctactgcactccagcctgggcgacagagccagactaagtctcaaaaaaaaaaaaaaaaaatcga

SEQ ID NO: 5410 - DNA, 757 bp, Homo sapiens
  misc_feature (741)..(741): n equals a,t,g, or c
gcacccccagaagttctgattcagtgggtggcgggtgaggcctgggaacttcatgacgagccccctggcaaggctgctgctgccattttggtgccacactttgggtactatggctttgggcactcccaatccaggtgccatggcatggggagcagtgggtgaaccaaatcctggagcctggactgttccattgggtgcattcctggctggcagatagaggaccacccagctgtgcttgatggggtctagaagcattgaaactggtttgccgttatgatgkccatgaggttggagtcctttyttagttaaaaatctgaagacccaacamcacacagmaccccacgctgaaccctcccgagaatgattgagctcttccaaataaaggscgattttgtagcttttcaagttttaacagtttgataactcccargctcctgttgagatgctttgtgatgaggttgtgcgttcccctgkatctttcctgtgggtgtttatgtgtacagaacacatgtatctgtatttacgtgactgagcacaggcgatttccccgagtctcaccttggtgtgtgccagtgcatgcgcgtgcgcgcgcgcacacacacacacacacatacctcctctcagagaatgttgatgtggcaattcatgtttgacagctgggttaacccatwaatagatcccaaaatataaatttacccagacctcaacctgcttaagcctttaaawagcycctagggcttntagaatgaagttgaaa
